(12) United States Patent
Paul et al.

(10) Patent No.: US 10,513,726 B2
(45) Date of Patent: Dec. 24, 2019

(54) METHODS FOR CONTROLLED IDENTIFICATION AND/OR QUANTIFICATION OF TRANSCRIPT VARIANTS IN ONE OR MORE SAMPLES

(71) Applicant: LEXOGEN GMBH, Vienna (AT)

(72) Inventors: Lukas Paul, Vienna (AT); Petra Kubala, Vienna (AT); Torsten Reda, Vienna (AT)

(73) Assignee: LEXOGEN GMBH, Vienna (AT)

( * ) Notice: Subject to any disclaimer, the term of this patent is extended or adjusted under 35 U.S.C. 154(b) by 160 days.

(21) Appl. No.: 15/323,951

(22) PCT Filed: Jul. 9, 2015

(86) PCT No.: PCT/EP2015/065756
§ 371 (c)(1),
(2) Date: Jan. 4, 2017

(87) PCT Pub. No.: WO2016/005524
PCT Pub. Date: Jan. 14, 2016

(65) Prior Publication Data
US 2017/0321248 A1 Nov. 9, 2017

(30) Foreign Application Priority Data
Jul. 9, 2014 (EP) ..................................... 14176417

(51) Int. Cl.
| | | |
|---|---|---|
| *C12P 19/34* | (2006.01) | |
| *C12Q 1/6806* | (2018.01) | |
| *C12Q 1/6869* | (2018.01) | |
| *C12Q 1/682* | (2018.01) | |
| *C12Q 1/6844* | (2018.01) | |
| *C12Q 1/686* | (2018.01) | |

(52) U.S. Cl.
CPC ........... *C12Q 1/6806* (2013.01); *C12Q 1/682* (2013.01); *C12Q 1/686* (2013.01); *C12Q 1/6846* (2013.01); *C12Q 1/6869* (2013.01); *C12Q 2600/166* (2013.01)

(58) Field of Classification Search
None
See application file for complete search history.

(56) References Cited

U.S. PATENT DOCUMENTS

| | | | |
|---|---|---|---|
| 2002/0110828 A1* | 8/2002 | Ferea ................... | C12Q 1/6837 435/6.11 |
| 2004/0009512 A1 | 1/2004 | Ares et al. | |
| 2007/0072189 A1* | 3/2007 | Grody ................... | C12N 15/102 435/6.13 |

FOREIGN PATENT DOCUMENTS

| | | |
|---|---|---|
| EP | 233104 A1 | 8/1987 |
| WO | 02/090516 A2 | 11/2002 |
| WO | 2016/005524 A1 | 1/2016 |

OTHER PUBLICATIONS

Aird et al. "Quantitative high-throughput profiling of snake venom gland transcriptomes and proteomes (Ovophis okinavensis and Protobothrops flavorviridis)." BMC Genomics, 2013, 14:790.
Baker et al. "The External RNA Controls Consortium: a progress report." Nature Methods, Oct. 2005, 2(10):731-734.
Benson et al. "Genbank." Nucleic Acids Research, 2013, 41:D36-42, Oxford University Press.
Blomquist et al. "Targeted RNA-Sequencing with Competitive Multiplex-PCR Amplicon Libraries." PLOS one, 2013, 8(11): e79120.
Brennecke et al. "Accounting for technical noise in single-cell RNA-seq experiments." Nature Methods, Nov. 2013, 10(11):1093-1098.
Bullard et al. "Evaluation of statistical methods for normalization and differential expression in mRNA-Seq experiments." BMC Bioinformatics, 2010, 11:94-107.
Cronin et al. "Universal RNA Reference Materials for Gene Expression." Clinical Chemistry, 2004, 50(8):1464-1471.
Devonshire et al. "Evaluation of external RNA controls for the standardisation of gene expression biomarker measurements." BNC Genomics, 2010, 11:662.
Hu et al. "PennSeq: accurate isoform-specific gene expression quantification in RNA-Seq by modeling non-uniform read distribution." Nucleic Acids Research, 2014, 42(3):e20.
Jiang et al. "Synthetic spike-in standards for RNA-seq experiments." Genome Res, 2011, 21:1543-1551, Cold Spring Harbor Laboratory Press.
Karlin and Altschul. "Methods for assessing the statistical significance of molecular sequence features by using general scoring schemes." Proc. Natl. Acad. Sci. USA, Mar. 1990, 87:2264-2268.
Koscielny et al. "ASTD: The Alternative Splicing and Transcript Diversity database." Genomics, 2009, 93:213-220, Elsevier.
Lin et al. "Transcriptional Amplification in Tumor Cells with Elevated c-Myc." Cell, Sep. 28, 2012, 151(1):56-67, Elsevier.
Loven et al. "Revisiting Global Gene Expression Analysis." Cell, Oct. 26, 2012, 151(3):476-482, Elsevier.

(Continued)

*Primary Examiner* — Kenneth R Horlick
(74) *Attorney, Agent, or Firm* — Wagenknecht IP Law Group, PC

(57) ABSTRACT

The present invention relates to the field of transcriptomics and provides a method for the controlled identification and/or quantification of transcript variants in samples, comprising providing a reference set of artificial polynucleic acid molecules simulating transcript variants and adding said reference set as external control to samples comprising transcript variants. The present invention further provides such a reference set, as well as a method to produce such a reference set.

8 Claims, 16 Drawing Sheets
Specification includes a Sequence Listing.

(56) References Cited

OTHER PUBLICATIONS

Nilsen and Graveley. "Expansion of the eukaryotic proteome by alternative splicing." Nature, Jan. 28, 2010, 463:457-463.
Rapaport et al. "Comprehensive evaluation of differential gene expression analysis methods for RNA-seq data." Genome Biology, 2013, 14:R95.
Reid et al. "Proposed methods for testing and selecting the ERCC external RNA controls." BMC Genomics, 2005, 6:150.
Rice et al. "EMBOSS: The European Molecular Biology Open Software Suite." TIG, Jun. 2000, 16(6): 276-277.
Roberts et al. "Improving RNA-Seq expression estimates by correcting for fragment bias." Genome Biology, 2011, 12:R22.
Sanna et al. "Overlapping genes in the human and mouse genomes." BMC Genomics, 2008, 9:169.
Shi et al. "The MicroArray Quality Control (MAQC) project shows inter- and intraplatform reproducibility of gene expression measurements." Nature Biotechnology, Sep. 2006, 24(9):1151-1161.
Shippy et al. "Using RNA sample titrations to assess microarray platform performance and normalization techniques." Nat Biotechnol., Sep. 2006, 24(9):1123-1131.
Sun et al. "Simultaneous quantification of alternatively spliced transcripts in a single droplet digital PCR reaction." BioTechniques, Jun. 2014, 56:319-325.
Trapnell et al. "Transcript assembly and quantification by RNA-Seq reveals unannotated transcripts and isoform switching during cell differentiation." Nature Biotechnology, May 2010, 28(5):511-518.
Wang et al. "Alternative isoform regulation in human tissue transcriptomes." Nature, Nov. 27, 2008, 456:470-476, Macmillan Publishers Limited.
Wang et al. "RNA-Seq: a revolutionary tool for transcriptomics." Nat Rev Genet. Jan. 2009, 10(1):57-63, Macmillan Publishers Limited.
Xin et al. "Alternative Promoters Influence Alternative Splicing at the Genomic Level." PLOS One, 2008, 3(6):e2377.
Yoon et al. Genetics and Regulatory Impact of Alternative Polyadenylation in Human B-Lymphoblastoid Cells, PLUS Genet., Aug. 2012, 8(8):e1002882.
Zhang and Drabier. "SASD: the Synthetic Alternative Splicing Database for identifying novel isoform from proteomics." BMC Bioinformatics, 2013, 14(Suppl 14):S13.
EP14176417 Extended European Search Report dated Apr. 2, 2015.
PCT/EP2015/065756 International Search Report and Written Opinion dated Aug. 25, 2015.
JP2017-501008 Office Action dated Jul. 3, 2018.
EP15736490.2 Communication pursuant to Article 94(3) EPC dated Jun. 3, 2019.
Li et al. "RSEM: accurate transcript quantification from RNA-Seq data with or without a reference genome," BMC Bioinformatics, 2011, 12(323):1-16.
Paul et al. "SIRVs: Spike-In RNA Variants as External Isoform Controls in RNA-Sequencing," bioRxiv, Oct. 13, 2016, 1-33.

* cited by examiner

```
XhoI    ----T7 promoter----   SIRV mRNA body   ----------(A)30 tail-----------  NsiI
5'C|TCGA-GCTAATACGACTCACTATAG-GCTAATACGACTCACTATAG...161-2498bp...AAAAAAAAAAAAAAAAAAAAAAAAAAAAAA-TGCA|T
3'G-AGCT|CGATTATGCTGAGTGATATC..................................TTTTTTTTTTTTTTTTTTTTTTTTTTTTTT|ACGT-A
```

Figure 11

METHODS FOR CONTROLLED IDENTIFICATION AND/OR QUANTIFICATION OF TRANSCRIPT VARIANTS IN ONE OR MORE SAMPLES

CROSS-REFERENCE TO RELATED APPLICATIONS

This application claims is a National Phase application under 35 U.S.C. § 371 of PCT Application No. PCT/EP2015/065756, filed Jul. 9, 2015, which claims benefit of priority to European Application No. 14176417.5, filed Jul. 9, 2014. The content of each is herein incorporated by reference in its entirety.

REFERENCE TO SEQUENCE LISTING SUBMITTED ELECTRONICALLY

The official copy of the sequence listing was submitted to the international bureau with international application PCT/EP2015/065756 on Jan. 14, 2016, a copy of which was generated into ASCII format as file PCTEP2015065756ASCII on Jan. 4, 2017 having a size of 854 KB. This sequence listing forms part of the application and is herein incorporated by reference in its entirety.

FIELD OF INVENTION

The present invention relates to the field of transcriptomics, especially whole transcriptome shotgun sequencing ("RNA-seq"). More specifically, it relates to methods and products suitable for the identification and quantification of RNA transcript variants in samples analysed by RNA-seq or micro-array analysis or quantitative PCR (qPCR).

BACKGROUND

Next generation sequencing (NGS) technology produces a large amount of short reads when sequencing a nucleic acid sample. An essential step in next generation sequencing is the library preparation or library prep for short. This process takes mRNA or cDNA as input and produces a library of short cDNA fragments, each corresponding to a section of an mRNA molecule. These fragments are then sequenced by an NGS sequencer, usually not in their entirety but partially at their start and/or at their end. This results in short sequences of nucleotides which are called reads and are most commonly stored by the NGS sequencer as sequences of a group of four ASCII characters such as A, C, G, T or 0, 1, 2, 3, representing the nucleobases of the genetic code. In order to infer which mRNA molecules were present in the original sample, the reads are mapped, or aligned, onto a reference genome or transcriptome, or de novo assembled based on sequence overlaps.

Next generation sequencing has been employed in a variety of genome mapping procedures (US 2013/110410 A1) or DNA identification methods, e.g. by using a mapped genome to associate sequence reads to a certain organism variant (WO 2009/085412 A1).

WO 2009/091798 A1 describes a method for obtaining a profile of a transcriptome of an organism, the method comprising: sequencing one or more cDNA molecules to obtain sequencing reads; aligning each of the sequencing reads to a reference sequence.

However, a major problem underlying transcriptome analysis using short sequence reads is the alignment step in case of transcript variants as described in the following paragraphs. It is usually difficult to align short sequence reads correctly to one transcript variant and especially to reliably quantify all transcript variants present in a sample.

The EP 2 333 104 A1 relates to an RNA analytics method of ordering nucleic acid molecule fragment sequences derived from a pool of potentially diverse RNA molecules. Genes are not only expressed in one transcript variant, but many transcript isoforms can be transcribed from a given genomic region (see for instance Nilsen and Graveley, 2010; Wang et al., 2009; Koscielny et al., 2009), with variation in their exon-intron composition and transcription start-(TSS) and end-sites (TES). Transcript isoforms can also differ in their abundance by up to six orders of magnitude, adding an additional layer of complexity (Aird et al., 2013). Zhang et al. relates to a synthetic alternative splicing database.

Analyzing the transcriptome in its complexity by RNA-Seq requires aligning of short reads to an annotated reference genome and deriving transcript analogies and hypothesis from unique features such as contig coverage and telling exon-exon junctions (see for instance Wang et al., 2009). These algorithms are far from being accurate suffering from insufficient and differently curated annotation and the inherent problem of discerning transcript variants that share similar feature and are expressed at similar levels. Transcriptome de novo assembly without using genome sequences and annotations are even more difficult and inefficient and mostly applied to not well characterized organisms.

It is a goal of the present invention to provide methods and products that allow a more accurate assessment (i.e. identification and quantification) of transcript variants in samples.

SUMMARY OF THE INVENTION

The present invention provides a method for the controlled identification and/or quantification of transcript variants in one or more samples, comprising:

a) providing a reference set of artificial nucleic acid (NA) molecules simulating transcript variants, comprising at least one, preferably at least two, more preferably at least three, especially at least five different families of NA molecules, with each family consisting of at least two, preferably at least three, more preferably at least four, especially at least five different NA molecules, wherein, independently for each family, all NA molecules of said each family are reference transcript variants of the same artificial gene, and wherein, independently for each family, the NA molecules of said each family share a sequence of at least 80 nucleotides (nt) in length, preferably at least 100 nt, more preferably at least 150 nt, especially at least 200 nt, and at least two NA molecules of said each family differ by at least another sequence of at least nt length, preferably at least 100 nt, more preferably at least 150 nt, even more preferably at least 200 nt, especially at least 300 nt, and wherein at least two, preferably each, of said NA molecules are present in preset molar amounts; and b) adding said reference set as external control to the one or more samples comprising transcript variants; and c1) performing NA sequencing based on read generation and assignment wherein a reference read assignment is generated with the reads of the reference set and said reference read assignment is used to control, verify, or modify the read assignment of the transcript variants of the one or more samples; or c2) performing a NA detection or quantification method, preferably micro-array analysis or qPCR, on the one or more samples, wherein at least one probe binds to at least one NA molecule of the reference set and a measuring result based on a signal resulting from the at least one probe binding to the at least one NA molecule of the reference set is used to control, verify, or modify a measuring result based on a signal resulting from the transcript variants of the one or more samples binding to a probe in said NA detection or quantification method.

The invention further provides reference sets of artificial NA molecules that are well suited for being used in the above method, as well as a method to produce such a reference set, as well as NA molecules suitable to be contained in such reference sets.

The following detailed description and preferred embodiments apply to all aspects of the invention and can be combined with each other without restriction, except were explicitly indicated. Preferred embodiments and aspects are further defined in the claims.

BRIEF DESCRIPTION OF THE DRAWINGS

FIG. 11: SIRV layout. All SIRV cassettes start with the XhoI restriction site, followed by the T7 promoter, a guanosine and the SIRV mRNA body. Every SIRV holds a poly(A) tail of 30 adenosines at its 3' end as well as a NsiI restriction site to enable run-off transcription.

DETAILED DISCLOSURE OF THE INVENTION

Figure 1:
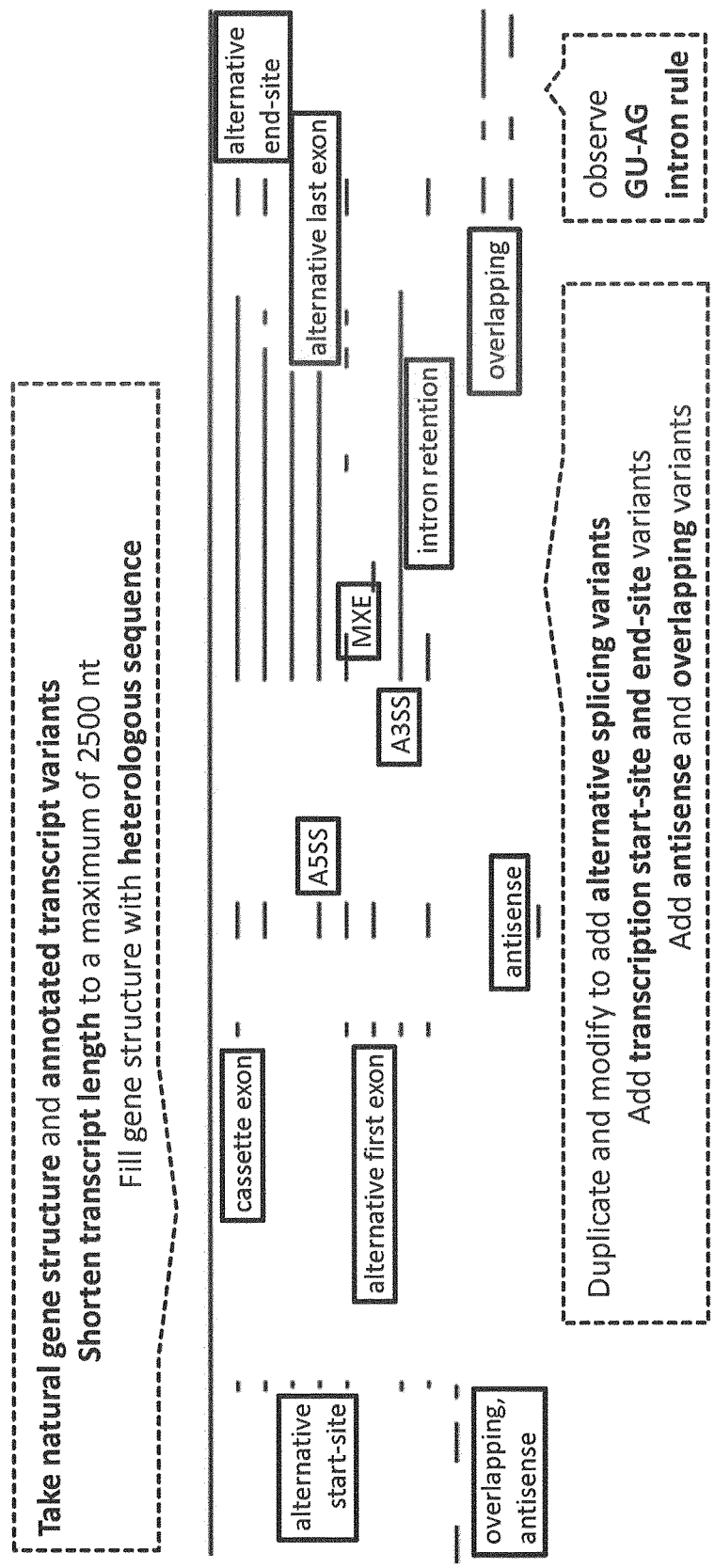
FIG. 1: Schematic overview of the SIRV design principles.

Internal, external, relative and absolute standards are essential for determining different quality metrics of samples comprising transcript variants (which applies to almost all transcript samples from eukaryotic cells) and methods striving to analyse such complex transcript samples. Quantitative data can be expressed in either relative or absolute terms. Each different method, e.g. microarrays, qPCR or NGS, has a number of peculiarities in the data analysis with respect to standardizing measurement results.

For relative quantitation in microarrays and qPCR RNA levels are compared between samples using internal or external controls to normalize for differences in sample concentration and loading. NGS experiments use different normalization procedures to the number of reads, and the length of identified transcripts. The results depend on many variables like the quality and state of the gene annotation, or the agreement between the library preparation and sequencing biases with the alignment and assembly algorithms. Controls are for example required to compensate for differences in the library preparation efficiency.

Controls are genes which are expressed (internal reference) or RNAs which are spiked-in (external references) at a constant level across the sample set. For quantitation signal intensities (fluorescent units or read counts) representing the expression levels of the experimental gene, exon, or tag are related to standards which contain known quantities, or ratios, and were defined as absolute or relative references.

The US 2004/009512 A1 discloses a method to analyse mRNA splice products using an internal control probe (claim 7, para. [0097] and [0106] of the document). There is no disclosure of internal controls representing variants having the lengths of the molecules the present invention relates to.

A number of complex RNA standard samples, e.g. universal human reference RNA and universal human brain reference RNA (Ambion, Life Technologies), are commercially available. Those standards are pooled from multiple donors and several tissues/brain regions, thus aim for a broadly unbiased and reproducible coverage of the gene expression. Experiments on such standard samples provide reference data and are used to validate and evaluate experimental methods. To interlock the measurements of unknown samples with each other and to said standard samples internal or external standards are required.

Internal RNA standards are genes which are expressed at a relative constant level across all of the samples being analyzed. Internal standards should be expressed equally among different tissues of an organism, at all stages of development, and for both control and experimentally treated cell types and are often referred to as "housekeeping" genes. Unfortunately, there is no single RNA with a constant expression level in all of these situations although 18S rRNA appears to come close to being an ideal internal control under the broadest range of experimental conditions. However, the relative high abundance of rRNAs lead to library preparation methods which specifically deplete rRNAs to free sequencing space.

It is therefore necessary to identify for the particular experimental questions an appropriate control RNA, which will be most likely mRNA. This, in turn, requires the consideration of the effect of mRNA isoforms on the suitability of the standard. Although some internal standards can be found (β-actin, glyceraldehyde-3-phosphate-dehydrogenase (GAPDH), or cyclophilin mRNA) only external standards provide controlled and reliable reference values. Constant sources from RNA samples of other species could be used as external standards, e.g. bacterial transcriptomes added to mammalian samples. However, because even simpler organisms like prokaryotes have already such high numbers of transcripts a balanced representation across the whole dynamic (concentration) range would waste too much sequencing space. Therefore, an external standard of low complexity but comparable dynamic range was developed previously, the ERCCs.

The ERCC consortium led by the National Institute of Standards and Technologies (NIST, USA) and consisting of 37 institutes together synthesized control RNAs by in vitro transcription of synthetic DNA sequences or of DNA derived from the Bacillus subtilis or the deep-sea vent microbe Methanocaldococcus jannaschii genomes. These transcripts are intended to be monoexonic and non-isoformic, i.e. they do not represent splice or other transcript variants. The consortium decided on poly(A) tail lengths between 19-25 adenines (23 adenosines median), a length of 250-2000 nt and a GC-content of ~30-55%. These diverse sequences show at least some of the properties of endogenous transcripts, such as diversity in the GC content and length. ERCC RNAs show minimal sequence homology with endogenous transcripts from sequenced eukaryotes (External RNA Controls Consortium, 2005a). The ERCC mix development is documented in a special report (External RNA Controls Consortium, 2005).

Blomquist et al. relates to DNA sequencing by NGS and uses a method employing synthetic internal standards (abstract and FIG. 1 of the document). During RNA processing, ERCC Spike-in Control internal standards are used (p. 4, left col. of the document). Devonshire et al. also relates to the ERCCs.

Ambion (part of Life Technologies) provides 92 ERCC transcripts commercially, either in a stand-alone mix (in concentrations spanning 6 orders of magnitude) or in 2 mixes designed to be spiked into two samples that should be compared for differential gene expression (measuring the accuracy of determining fold-changes; User Guide: ERCC RNA Spike-In Control Mixes, Ambion).

While initially conceived to be used in qPCR and microarray systems, they are now widely employed in RNA-Seq NGS experiments. This different intentional purpose makes the current use of ERCCs questionable.

Limits of the ERCCs are that they are i) limited in their size range, ii) contain only short poly(A)-tails and iii) no cap-structure. However, the main disadvantage of the ERCCs is that they do not contain transcript variants of any kind. Therefore, they are not suitable for controlled identification and/or quantification of transcript variants and for evaluating sequencing methods (or other analysis methods) in this respect. Another disadvantage is that they have similarity to known sequences (Bacillus and Methanococcus).

Sun et al. relates to the quantification of alternatively spliced transcripts. Splice variants of the human telomerase reverse transcriptase are used as controls. Approximately 20 splice variants are known, 4 of which are common in tumors (p. 319, middle col. of the document). The common 4 have been investigated in the document (p. 320 middle col. and FIG. 1; p. 321, left col.; table 1 of the document). However, the document does not relate to artificial transcript variants and the control of the document is restricted to a single human gene, unlike the present invention which allows representative and accurate simulation of alternative splicing events without having to rely on natural sequences (which reliance on natural sequences can in fact interfere with the experiment).

The present invention overcomes these disadvantages, among others. In the course of the present invention, many different methods and reference sets were developed and characterized in order to come up with the methods and products exceptionally suitable for solving the present problem of identifying and quantifying transcript variants.

Therefore, in an aspect of the present invention, a method is provided for the controlled identification and/or quantification of transcript variants in one or more samples, comprising:

a) providing a reference set of artificial nucleic acid (NA) molecules simulating transcript variants, comprising at least one, preferably at least two, more preferably at least three, especially at least five different families of NA molecules, with each family consisting of at least two, preferably at least three, more preferably at least four, especially at least five different NA molecules,
  wherein, independently for each family, all NA molecules of said each family are reference transcript variants of the same artificial gene, and
  wherein, independently for each family, the NA molecules of said each family share a sequence of at least 80 nucleotides (nt) in length, preferably at least 100 nt, more preferably at least 150 nt, especially at least 200 nt, and at least two NA molecules of said each family differ by at least another sequence of at least nt length, preferably at least 100 nt, more preferably at least 150 nt, even more preferably at least 200 nt, especially at least 300 nt, and
  wherein at least two, preferably each, of said NA molecules are present in preset molar amounts (which makes the reference set especially suitable for the present method, as it allows e.g. normalisation of the sample read assignment to the reference (i.e. control) read assignment); and
b) adding said reference set as external control to the one or more samples comprising transcript variants (The reference set can be physically added into the same sample container(s) and/or into a separate container for analysis. In addition, or alternatively, it can also be non-physically added in a computer-implemented method step: by using prior measurements of the reference set, from the same analysis instrument, the same model of analysis instruments or other analysis instrument models); and
c1) performing NA sequencing based on read generation (the read can have any length) and assignment (i.e. mapping the reads onto a reference sequence) wherein a reference read assignment is generated with the reads of the reference set and said reference read assignment is used to control, verify, or modify the read assignment of the transcript variants of the one or more samples; or
c2) performing a NA detection or quantification method, preferably micro-array analysis or qPCR, on the one or more samples, wherein at least one probe binds to at least one NA molecule of the reference set and a measuring result based on a signal resulting from the at least one probe binding to the at least one NA molecule of the reference set is used to control, verify, or modify a measuring result based on a signal resulting from the transcript variants of the one or more samples binding to a probe in said NA detection or quantification method. In qPCR, the probe can be a primer that is extended in a PCR reaction or a labelled DNA probe; in micro-array analysis the probe can be a DNA probe immobilised on a DNA chip.

The NA can be a DNA or RNA. Preferably, it is RNA. One of skill in the art is free to choose when to apply the reference set as DNA or RNA. One of skill also knows how to prepare samples for NA sequencing or a NA detection or quantification method. Beneficially, the reference set is added early during sample preparation before applying NA sequencing or a NA detection or quantification method, so that the reference set is present during all or most sample preparation steps. To this end, it is preferably added as RNA, as the transcript variants (the molecules of interest) are typically mRNA molecules early during the sample preparation.

The term "artificial", as in "artificial NA molecule" or "artificial gene" or "artificial sequence", as used throughout the document means that the entity referred to as artificial does not occur in natural biological organisms (such as microbes, animals or plants) but has been deliberately thought up and created by man. However, an artificial entity such as an artificial NA molecule or artificial gene can still be produced in recombinant organisms (e.g. introduced into and expressed in naturally-occurring *E. coli* cells) without losing its quality of being artificial.

Artificial NA molecules are exceptionally well-suited for the method of the present invention, especially when they bear no or only negligible sequence homology to known NA sequences. This allows for unambiguous assignment of reads as "reference reads" (i.e. generating a reference read assignment) even for the short sequences (e.g. between 40-80 nt or even between 20-200 nt) which are typical for next generation sequencing reads.

In general, a transcript is a transcription product (for instance synthesized by an RNA polymerase) from one gene (for instance from a DNA template) consisting of an RNA sequence reaching from the transcription start site to the transcription end site. For the purposes of the present invention, a transcript is an NA molecule comprising at least one exon. The word transcript describes either a single molecule or the group of all molecules with identical sequence. As is well-known, in eukaryotes mRNA (transcripts) are processed (especially by splicing) from pre-mRNA (also referred to as heterogeneous nuclear ribonucleic acid) to render mature transcripts. By definition, the sequence regions that are spliced out of the transcript are called introns, the sequence regions that remain in mature transcripts are called exons. An exon in one mature transcript variant, may be an intron for another mature transcript variant (by virtue of not being present in said variant). It is clear to one of skill how to annotate gene sequence regions as exons and introns when the sequences of all transcript variants are known. As used herein, an exon is a sequence region that may be an exon in any variant. It usually is characterized through rather conserved sequences at both ends of the enclosed intron region and is forming so-called exon-exon junctions with the neighbouring exons, see also Table 2. A natural exon can be part of a coding region (or vice versa), however, in case of the inventive artificial NA molecules the exon is preferably not part of a coding region (or vice versa) for artificial proteins, or natural proteins since the inventive artificial sequences are designed to lack similarity to known transcripts present in organisms existing in nature, and do not contain reading frames with start and stop codon or open reading frames (ORF) with a start codon only. Exons comprised in the artificial NA molecules of the invention are artificial exons because they comprise an artificial sequence. The word "transcript" herein shall be interpreted as meaning "mature transcript", unless stated otherwise.

In the broadest terms, a transcript "variant" is a transcript of a gene, wherein at least two transcripts of said gene exist, wherein the transcript differs from another of the at least two transcripts by at least one nucleotide (generated by an "alternative transcription event"). However, in the context of the present method, the artificial NA molecules of each (transcript) family share, independently for each family, a sequence of at least 80 nucleotides in length (preferably at least 100 nt, more preferably at least 150 nt, especially at least 200 nt) and, independently for each family, at least two NA molecules of each family differ by at least another sequence of at least 80 nucleotides length (preferably at least 100 nt, more preferably at least 150 nt, even more preferably at least 200 nt, especially at least 300 nt). Other members of the family may differ from further members by only one nucleotide, but greater differences between variants are preferred—e.g. down to just a 80 nt or 100 nt or 150 nt or 200 nt stretch of sequence identity between all members of the family.

Figure 2:
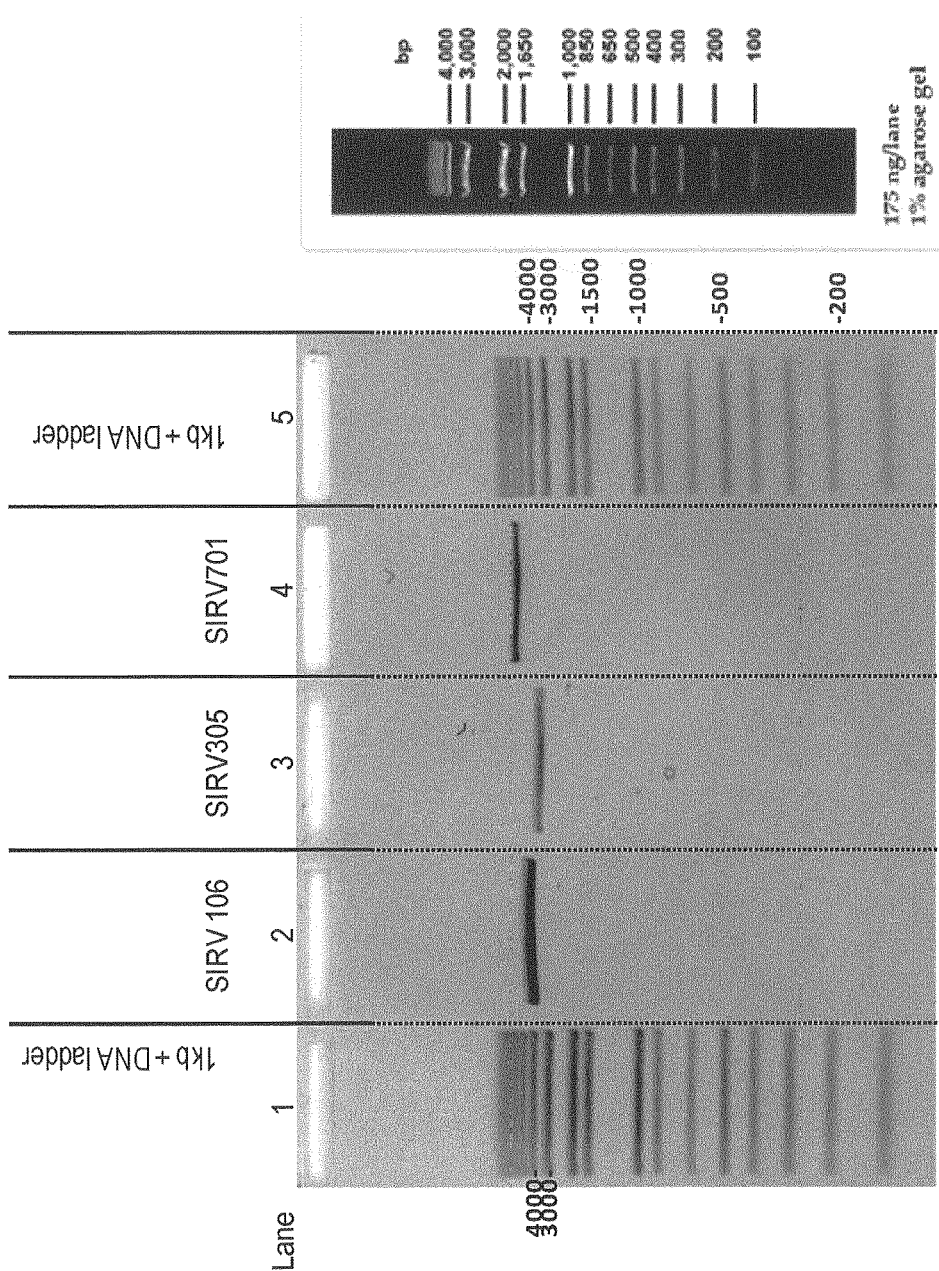
FIG. 2: Exemplary results for plasmid linearization of selected SIRVs after DNA synthesis. The SIRVs have the correct size and can be used for RNA transcription by T7 polymerase.

Herein, "simulating transcript variants" (of an artificial gene) means having features representative of naturally-occurring eukaryotic (preferably animal or plant, more preferably vertebrate, even more preferably mammalian, especially human) transcripts of naturally-occurring eukaryotic (preferably animal or plant, more preferably vertebrate, even more preferably mammalian, especially human) genes. One of skill in the art is familiar with these typical features of transcript variants. These features comprise one or more of: being the result of one or more alternative splicing events (see below and Table 1), having certain intronic splice site dinucleotides (see below and Table 2), having alternative transcript start- and end-sites (see below), being antisense transcripts, overlapping with other genes/transcripts, being polyadenylated (see also Wang et al., 2008). Additionally, or alternatively, features defined in Wang et al., 2008, especially FIG. 2, can be used. Beneficially, the entirety of the NA (RNA or DNA) molecules of the reference set has at least one, preferably at least two, more preferably at least three, even more preferably at least four, especially at least five of the features recited in the previous two sentences, with each NA molecule having, independently of each other, none, one, two, three, four, five, or six of the features recited in the previous sentence, in at least one or at least two or at least three or at least four separate instances. It is not necessary for the NA molecules of the invention to be RNA molecules in order to simulate transcript variants. Simulation of transcript variants is also possible with DNA or other NA molecules.

For the purposes of the present invention, one may create an artificial genome that comprises artificial genes (conceptually in the computer, by arranging sequences). The sequence of this artificial genome may also be used for read assignment. An artificial gene has features known from naturally-occurring genes, such as a promoter, a transcription start site, a transcribed region and a transcription end site (also called terminator). The promoter region is irrelevant for the purposes of the present invention, as the present invention concerns simulating transcript variants of an artificial gene (and not the artificial gene or physical synthesis of a corresponding protein from said artificial gene itself). Artificial NA molecules that are reference transcript variants of the same artificial gene (i.e. members of a family of artificial NA molecules) are related to each other and to said artificial gene (by parameters such as size, and sequence) in the same ways as naturally-occurring transcripts of the same naturally-occurring gene are related to each other and to said naturally-occurring gene. Their common features may be that transcript variants share exons (or parts thereof) between them that are transcribed from the same hypothetical gene. It is clear to one of skill that, for the purposes of the present invention, the artificial gene is a mere concept to define the artificial NA molecules and does not have to be defined any more than is necessary for the definition of the artificial NA molecules (e.g. as mentioned before, the promoter region of the gene does not have to be defined).

Beneficially, the reference set of artificial polynucleic acid NA (RNA or DNA) molecules simulating transcript variants has frequencies of the typical transcript features mentioned in the previous paragraphs similar (at least +/−50%, preferably at least +/−25%, especially at least +/−10%) to the corresponding mean frequencies of the typical transcript features in the eukaryotic (preferably animal or plant, more preferably vertebrate, even more preferably mammalian, especially human) transcriptome (for instance as specified in the following paragraphs), in at least one, preferably in at least two of the typical transcript features, more preferably in at least three, especially in at least four, especially in all of the typical transcript features present in the reference set, in at least one or at least two or at least three or at least four separate instances.

Alternative Splicing Events (AS):

The term alternative splicing is used in biology to describe any case in which a primary transcript (pre-mRNA) can be spliced in more than one pattern to generate multiple, distinct mature mRNAs. The most common types of alternative splicing events are shown in Table 1. In humans, exon skipping is with ~33% the most common splicing event found. Alternative 5' and 3' splice sites follow with ~25% each. Also, alternative splice sites often occur together (Barbazuk et al., 2008; Roy et al., 2013). Brain tissue and tissue of testis were found to hold high numbers of AS events (Roy et al., 2013). Beneficially, the entirety of the NA molecules of the reference set has at least one, preferably at least two, more preferably at least three, even more preferably at least four, especially at least five of the features recited in Table 1, with each NA molecule having, independently of each other, none, one, two, three, four, five, six or seven of the features recited in the previous sentence, in at least one or at least two or at least three or at least four separate instances.

TABLE 1

Alternative Splicing Events.
The list shows several alternative splicing events derived from Ensembl gene annotation. The Ensembl gene set includes both automatic and manual annotation, with all transcripts based on experimental evidence (see also Wang et al., 2008).

| AS Pattern Type | Acronym | Definition |
|---|---|---|
| Cassette exon (skipped exon) | CE | One exon is spliced out of the primary transcript together with its flanking introns. |
| Intron retention | IR | A sequence is spliced out as an intron or remains in the mature mRNA transcript. |
| Mutually exclusive exons | MXE | Refer to a case in which multiple cassette exons are used in a mutually exclusive manner. In the simplest case: two consecutive exons that are never both included in the mature mRNA transcript. |
| Alternative 3' sites | A3SS | Also called alternatively acceptor sites. Two or more splice sites are recognized at the 5' end of an exon. An alternative 3' splice junction (acceptor site) is used, changing the 5' boundary of the downstream exon. |
| Alternative 5' sites | A5SS | Also called alternative donor sites. Two or more splice sites are recognized at the 3' end of an exon. An alternative 5' splice junction (donor site) is used, changing the 3' boundary of the upstream |

TABLE 1-continued

Alternative Splicing Events.
The list shows several alternative splicing events derived from Ensembl gene annotation. The Ensembl gene set includes both automatic and manual annotation, with all transcripts based on experimental evidence (see also Wang et al., 2008).

| AS Pattern Type | Acronym | Definition |
|---|---|---|
| Alternative first exon | AFE | exon. Second exons of each variant have identical boundaries, but first exons are mutually exclusive. This is to annotate possible alternative promoter usage. |
| Alternative last exon | ALE | Penultimate exons of each splice variant have identical boundaries, but last exons are mutually exclusive. This is to allow annotation of possible alternative polyadenylation usage. |

Antisense Transcripts and Overlapping Genes:

Monoexonic anti-sense transcripts as well as overlapping variants were designed as the latter constitute a significant share of all transcripts for a subset of genes (9% in humans, 7.4% in mouse; Sanna et al., 2008). The overlapping variants can be monoexonic or spliced (e.g. 3 exons with only the terminal exon overlapping) and in sense or antisense direction. Antisense-oriented genes can be 10-fold more frequent than overlapping genes in the same direction. Beneficially, the entirety of the NA molecules of the reference set comprise at least one, preferably at least two, more preferably at least three, even more preferably at least five overlapping transcripts, in sense and/or antisense direction. Preferably, the frequency of such transcripts is about 10% of all transcripts present in the reference set. An antisense overlap between two artificial transcript variants can be in a length of e.g. 10 nt-500 nt.

Alternative Transcript Start- and End-Sites (TSS and TES):

In addition to the alternative splicing events resulting in alternative first and/or last exons (AFE and ALE), also variation in the actual start or end site of the transcript within an annotated exon or across exons is possible. For microvariations, the precise deviation from the annotated sites is debatable but usually is <20 nt. Moreover, they are functional similar, i.e. depending on the same promoter or the same polyadenylation signal and therefore co-vary in their regulation. For macrovariations, these alternative TSS and TES are typically depending on alternative promoters or polyadenylation signals and can be positioned within the same first or last exon or in neighbouring ones. They are positioned further apart, i.e. 500 nt can be taken as a reference distance for promoters (Xin et al., 2008) and 40 nt was seen as a regulatory distance in a poly(A) site survey (Yoon et al., 2012). Therefore, beneficially, the entirety of the NA molecules of the reference set comprise at least one, preferably at least two, more preferably at least three, even more preferably at least five TSS and/or TES. Preferably, at least two transcript variants in a family differ by at least 1 nt, preferably 2 nt, 3 nt, 4 nt, 5 nt or more, in a 20 nt, preferably in a 10 nt, long 5' or 3' terminal region. Especially preferred the differing nts are at the 5' or 3' terminus itself.

Herein, alternative splicing events, alternative transcript start- and end-sites and antisense transcripts and overlapping genes are subsumed under the term "alternative transcription events".

Intronic Splice Site Dinucleotides:

Most introns have common consensus sequences near their 5' and 3' ends that are recognized by spliceosomal components and are required for spliceosome formation (FIG. 1). For the major class, splice junction pairs are highly conserved and typical comprise the intron donor and acceptor sequence GT-AG (98.70% of annotated junctions), followed in frequency by GC-AG and AT-AC (Table 2). In a more general view, the most common exon-intron sequences can be depicted as: exon . . . AT(cut)GT . . . intron . . . AG(cut)G . . . next exon. In Table 2, the frequencies of donor-acceptor pairs are given. To account for this conservation and moderate variability, it was aimed for 97% of all junctions to be GT-AG, 2% GC-AG and 1% AT-AC. This mimicking should allow aligners (such as TopHat) to use and evaluate their existing junction tables. Exon boundaries should be 5' AG and 3' AT where they do not interfere with the more important intron junction dinucleotides. Beneficially, the entirety of the NA molecules of the reference set comprises one, preferably two, especially all intron donor-acceptor dinucleotides of an exon, such as selected from GU-AG, GC-AG, AU-AC, preferably with a frequency of about 97%, 2% and 1% of all intron donor-acceptor dinucleotides present, respectively.

TABLE 2

Canonical and noncanonical donor acceptor pairs.
Splice site dinucleotides derived from the Information for the Coordinates of Exons (ICE) database, of genomic splice sites (SSs) for 10,803 human genes. From 256 theoretically possible pairs of donor and acceptor dinucleotides, the three most represented specific pairs (GT-AG, GC-AG and AT-AC) cover 99.56% of all cases (91,022 out of 91,846) (Chong et al., 2004).

| # | Dinucleotide | Fraction |
|---|---|---|
| 1 | GT-AG | 98.70% |
| 2 | GC-AG | 0.79% |
| 3 | AT-AC | 0.08% |
| 4 | GT-GG | 0.06% |
| 5 | GG-AG | 0.04% |
| 6 | GA-AG | 0.03% |
| 7 | GT-TG | 0.03% |
| 8 | AT-AT | 0.03% |
| 9 | GC-CA | 0.03% |
| 10 | GT-AT | 0.02% |
| 11 | AA-AG | 0.02% |
| 12 | AT-AG | 0.02% |
| 13 | GC-CT | 0.02% |
| 14 | GT-CT | 0.02% |
| 15 | GT-TT | 0.02% |
| 16 | AG-AG | 0.02% |
| 17 | GC-GG | 0.02% |
| 18 | GC-TG | 0.02% |
| 19 | GT-GA | 0.02% |
| 20 | CA-AG | 0.01% |
| 21 | CC-AT | 0.01% |
| 22 | GG-CA | 0.01% |

Polyadenylation:

Mature eukaryotic transcripts are known to have a poly (A) tail. Beneficially, the artificial NA molecules of the present invention or for use in the method of the present invention have a poly(A) tail of at least 10, preferably at least 20, especially at least 30 adenosines, which supports close simulation of actual transcripts. In addition, it ensures (especially with at least 30 adenosines) proper oligo(dT) bead purification, and also helps balancing the 5'/3' primer melting temperatures (Tm) in a PCR amplification reaction with T7-promoter and poly(A) binding primers, for universally amplifying all constructs.

The above method of the invention preferably comprises performing NA sequencing based on read generation (the read can have any length) and assignment (i.e. mapping the reads onto a reference sequence) wherein a reference read assignment is generated with the reads of the reference set and said reference read assignment is used to control, verify, or modify the read assignment of the transcript variants of the one or more samples. It is known in the art how to use external controls to control, verify, or modify the read assignment (e.g. Jiang et al., 2011).

It was found in the course of the present invention, that providing the reference set of artificial NA molecules in dry form in a container, e.g. to be dissolved by the sample itself, reduces handling errors (see also Example 8). In addition, NA molecules (especially RNA molecules) are typically more stable when dry. Therefore, in a particularly preferred embodiment, the reference set of artificial NA molecules is provided dried, preferably freeze-dried, in a container. Typically, a separate container with a reference set is provided for each sample. Preferably, stabilizing agents (that reduce the degradation of NA, especially RNA) are added to the reference set before, during or after drying, especially before the drying. Such stabilizing agents comprise antioxidants, EDTA, DDT, other nuclease or RNAse inhibitors (such as RNAsin® by Promega, RNAstable® by Biomatrica, GenTegra®-RNA by GenTegra). Typically, additional stabilization is more important for RNA molecules than for DNA molecules.

In accordance with the previous paragraph, in another highly preferred embodiment, the adding of the reference set as external control is performed by adding the sample to said container, thereby dissolving the dried reference set in the sample.

The following describes an example of how to control, verify or modify the read assignment of the transcript variants of the one or more samples: In this setting gene 1 (G1) has two transcript variants, G1T1 and G1T2, which differ from each other by one retained intronic sequence only. When aligner distribute the generated reads within the G1 locus using programmed probability algorithms which employ different models of weighting preset or derived information like start site distributions, sequence biases, length biases and above mentioned splice site dinucleotide annotations (Table 2) the eventually assigned reads are counted and normalized to eg. Fragments Per Kilobase Of Exon Per Million Fragments Mapped (FPKM) to obtain one measure for relative transcript concentrations and the ratio between G1T1 and G1T2. Depending on the experimental setting the FPKM values contain confidence intervals which are calculated from technical replicates within the very same experiment or estimated from previous reference experiments. If an aligning algorithm imposes false biases and generates false expression values the results for the G1T1 and G1T2 remain wrong, and moreover can be completely arbitrary when the samples themselves or experimental conditions are changing. Only the ground truth knowledge of a reference set, Ref1T1 and Ref1T2, with similar complexity (e.g. similar length, intron retention at the proximity) allows to evaluate the performance of the particular experiment from the library generation, through the sequencing up to the read assignment and to calculate the confidence interval for genes and transcript variant distributions of similar complexity. Thus the reference read assignment can be used to adjust or shift the statistical read assignment of the sample reads, such as based on normalization, preferably on a FPKM value. An error in the read assignment of the reference set can be corrected due to the known composition and amount of the reference set (the preset value, which can be selected at leisure suitable for a given platform) and said correction can be applied to modify the sample read assignment.

Alternatively, the above method of the invention preferably comprises performing a NA detection or quantification method, preferably micro-array analysis or qPCR, on the one or more samples, wherein at least one probe binds to at least one NA molecule of the reference set and a measuring result based on a signal resulting from the at least one probe binding to the at least one NA molecule of the reference set is used to control, verify, or modify a measuring result based on a signal resulting from the transcript variants of the one or more samples binding to a probe in said NA detection or quantification method. It is known in the art how to use external controls to control, verify, or modify a measuring result. See for instance Devonshire et al., 2010.

In the course of the present invention, it was surprisingly found that an adaptation of the above method is especially suitable for evaluating a NA sequencing method. It is also very suitable for evaluating a NA sequencing method, or for evaluating a NA detection or quantification method. Hence, in another aspect of the invention, a method is provided for evaluating a NA sequencing method, or for evaluating a NA detection or quantification method, comprising:

a) providing a reference set of artificial NA molecules simulating transcript variants (as explained before), comprising at least one, preferably at least two, more preferably at least three, especially at least five different families of NA molecules, with each family consisting of at least two, preferably at least three, more preferably at least four, especially at least five different NA molecules, wherein, independently for each family, all NA molecules of said each family are reference transcript variants of the same artificial gene, and wherein, independently for each family, the NA molecules of said each family share a sequence of at least 80 nt, preferably at least 100 nt, more preferably at least 150 nt, especially at least 200 nt, in length and at least two NA molecules of said each family differ by at least another sequence of at least 80 nt length, preferably at least 100 nt, more preferably at least 150 nt, even more preferably at least 200 nt, especially at least 300 nt and wherein at least two, preferably each, of said NA molecules is present in preset molar amounts; and b1) for evaluating the NA sequencing method, performing NA sequencing based on read generation and assignment wherein a reference read assignment is generated with the reads of the reference set; or b2) for evaluating the NA detection or quantification method, performing said NA detection or quantification method on the reference set, wherein at least one probe binds to at least one NA molecule of the reference set; and c) comparing an output result of any step b), in particular an output molar amount, an output concentration, and/or, in case of evaluating the NA sequencing method, a number of assigned reads, of at least one of the NA molecules of the reference set, and/or at least one ratio thereof of at least two NA molecules of the reference set, to said preset molar amounts and/or, in case of evaluating the NA sequencing method to a number of assigned reads, and/or a ratio and/or an output calculated or expected therefrom.

In essence, the present invention provides a method to "benchmark" (or compare or evaluate) various NA analysis methods, thereby allowing investigators (or producers of NA analysis methods and/or NA analysis instruments) to optimize their methods, especially in respect to being able to reliably identify and/or quantify transcript variants (as are typical for the transcriptome of complex organisms).

From the parameters known about the reference set (e.g. concentrations, sequences present, etc.—i.e. the reference set represents a known control in this case) one of skill is able to calculate or predict an expected result (e.g. number of reads, extrapolated concentrations, etc.). By comparing the (actual) output result to the expected result, one of skill is able to determine the divergence between actual result and expected result, thereby evaluating the nucleic acid sequencing method.

Notably, also computational aspects of a nucleic acid sequencing method may be evaluated, by (repeatedly) using a prior sequencing measurement of the reference set and (iteratively) changing the computational part of the sequencing method, in order to evaluate different computational method parts (e.g. algorithms) or in order to improve the method part (e.g. the algorithm or algorithms).

Beneficially, any reference set of the present invention (see below) is suitable for the above methods of the present invention, especially when at least two, preferably each, of the NA molecules of said reference set is present in preset molar amounts.

In the course of the present invention, many different reference sets (and production methods therefor) were characterised and finally a reference set (and a production method therefor) that is exceptionally well suited for the previously mentioned methods was found. (However, the previously mentioned methods are not limited to using the reference set of the invention; other reference sets may be suitable (but less so than the reference set of the present invention) as well.)

Therefore, in another aspect of the invention, a method is provided to produce a reference set of artificial NA molecules, preferably RNA or DNA molecules, simulating transcript variants, comprising:

A) selecting at least one, preferably at least two, more preferably at least three, especially at least five genes, from the group of naturally-occurring eukaryote genes, preferably animal or plant genes, more preferably vertebrate genes, even more preferably mammalian genes, especially human genes. It is known in the art where to find such genes. Preferably, this method step is performed computer-implemented with a software. For instance, one may obtain them (or their annotated sequences or their names for use in other public databases) from publicly accessible databases, such as Ensembl, National Center for Biotechnology Information (NCBI) GenBank or other NCBI databases. By way of example, for human genes, one can select genes from the following NCBI search query: http://www.ncbi.nlm.nih.gov/gene/?term=Homo+sapiens[Orgn] Alternatively, or additionally, one can browse genomes in the Ensembl database (http://www.ensembl.org). Preferably, the gene is well-annotated in respect to its transcript variants (transcript table) and introns/exons are annotated.

B) selecting at least two, preferably at least three, more preferably at least four, especially at least five naturally-occurring mRNA transcript variants for each selected gene, wherein each transcript variant has a length of at least 100 nt and comprises at least one exon. Preferably, this method step is performed computer-implemented with a software. By way of example, the Ensembl database contains well-annotated transcript variants (also called transcript table) of genes (e.g. human genes). For instance, http://www.ensembl.org/Homo_sapiens/Gene/Summary?g=ENSG000001396 18; r=13:32889611-32973805 shows the transcript table of the gene BRCA2. Ensembl also contains annotated splicing events (ASE) (Wang et al., 2008; Koscielny et al., 2009). The sequence annotation, FASTA files as text-based format are representing the pure nucleotide sequences, and are typically used together with transcript variant annotations commonly held in GTF files (General Transfer Format) which contain all relevant information like seqname—name of the chromosome or scaffold; chromosome names can be given with or without the 'chr' prefix; source—name of the program that generated this feature, or the data source (database or project name); feature—feature type name, e.g. Gene, Variation, Similarity; start—Start position of the feature, with sequence numbering starting at 1; end—End position of the feature, with sequence numbering starting at 1; score—A floating point value; strand—defined as + (forward) or − (reverse); frame—One of '0', '1' or '2'. '0' indicates that the first base of the feature is the first base of a codon, '1' that the second base is the first base of a codon, and so on . . . ; attribute—A semicolon-separated list of tag-value pairs, providing additional information about each feature. From the GTF files the different transcripts can be displayed by programs with zoom function for visual inspections.

C) providing the sequence of each of said selected naturally-occurring mRNA transcript variants comprising at least one exon, optionally wherein the sequence is converted to another NA type, such as a DNA sequence. It is trivial to convert an RNA into a DNA sequence. Preferably, this method step is performed computer-implemented with a software. Beneficially, the mRNA transcript variants are mature transcripts.

D) modifying each sequence of step C) by:

replacing the sequence of each exon of each sequence by a sequence of about the same length (as the exon sequence), independently for each exon, wherein the sequence of about the same length is selected from the group of:

viral sequences, bacteriophage sequences, inverted sequences thereof, any other inverted naturally-occurring sequences (inverting prevents alignment software from aligning the sequences to their original loci and also hybridisation with their original complement), non-naturally-occurring random sequences, and combinations thereof, preferably the sequence of about the same length is selected from the group of:

viral sequences, bacteriophage sequences, inverted sequences thereof, non-naturally-occurring random sequences, and combinations thereof, more preferably the sequence of about the same length is selected from the group of:

viral sequences, bacteriophage sequences, inverted sequences thereof, and combinations thereof, preferably wherein the sequence of about the same length is modified by replacing at most 3, preferably at most 2, especially at most 1 dinucleotides, independently of each other, by any other dinucleotide, preferably by GT, GC, or AT and/or by replacing at most 3, preferably at most 2, especially at most 1 dinucleotides, independently of each other, by any other dinucleotide, preferably by AG, AC or AT, preferably with the proviso that this dinucleotide exchange is performed so that the abundances of exon-encoded intron junction dinucleotides is 90-100% (GT-AG), 0-10% (GC-AC) and 0-2% (AT-AT) to reflect the naturally occurring frequencies as given for example in the Information for the Coordinates of Exons (ICE) database (Chong et al., 2004) (what is an exon in one sequence may be an intron for another transcript, by not being present in said other transcript).

thereby obtaining a set of artificial transcript sequences (comprising at least one artificial exon), with the proviso that the artificial transcript sequences obtained from the sequences of the selected naturally-occurring mRNA transcript variants of the same selected gene share a sequence of at least 80 nt in length, which is preferably comprised in a single exon sequence, and preferably with the proviso that, when an exon sequence of a sequence of step C) is identical to another exon sequence of a sequence of step C), the exon sequence and the another exon sequence is replaced by the same said sequence of about the same length.

Preferably, this method step is performed computer-implemented with a software. This step (and all subsequent preferably computational steps) may be performed for instance with the widely-used software CLC Main Workbench (QIAGEN), Bioconductor package, UCSC Genome Browser, or others.

Sequences may also be combined to form the sequence of about the same length, especially if a viral sequence, bacteriophage sequence, inverted sequences thereof, any other inverted naturally-occurring sequences, or non-naturally-occurring random sequence sequence is too short to fill an entire exon.

Beneficially, the length of a viral sequence, bacteriophage sequence, inverted sequences thereof, or any other inverted naturally-occurring sequences or non-naturally-occurring random sequences is at least 10 nt, preferably at least 20 nt, more preferably least 50 nt, especially at least 100 nt, especially in order to avoid combining too many short sequence stretches and thereby inadvertently creating a sequence that is too homologous to a eukaryotic sequence. Preferably, combination is conducted by concatenation of sequences.

Beneficially, certain restriction sites are removed from the artificial transcript sequences by introducing single point mutations (e.g. removing the restriction sites of XhoI and NsiI), to allow for better handling in cloning.

E) optionally duplicating at least one of the artificial transcript sequences of the set of step D) and adding said duplicated sequence to the set, thereby obtaining a set comprising a copy for alternative modification in one or more of steps F)-K).

This duplication allows simulating transcript variation events that should be present in the reference set (as the reference set is more suitable the more comprehensive it gets in regard to alternative transcription events) but do not occur with the selected genes. Preferably, this method step is performed computer-implemented with a software.

F) optionally inserting at least one sequence into at least one of the artificial transcript sequences of the set, wherein each of the at least one inserted sequences is, independently of each other, identical to a sense or anti-sense sequence (i.e. the reverse complement sequence) of the same length of any of the artificial transcript sequences of step D) and preferably has a length between 5 nt and 10000 nt, especially between 10 nt and 1000 nt.

Beneficially, at most five, preferably at most four, more preferably at most three, especially at most two insertions are performed per artificial transcript sequence. Preferably, this method step is performed computer-implemented with a software.

G) optionally removing at least one sequence with a length ranging from 1 nt to 10000 nt from at least one of the artificial transcript sequences of the set, wherein each of the one or more artificial transcript sequences remains at a size of at least 100 nt and remains comprising at least one exon sequence.

Beneficially, at most five, preferably at most four, more preferably at most three, especially at most two removals are performed per artificial transcript sequence. Preferably, this method step is performed computer-implemented with a software.

By combination of the steps E-G, it is possible to include additional alternative transcription events that are not present in the selected naturally-occurring mRNA transcripts. Preferably, this method step is performed computer-implemented with a software.

H) optionally establishing as the first nucleotide of each of the artificial transcript sequences a guanosine, by 5' truncating the sequence until the 5' end is a guanosine, by changing the first base to a guanosine or by adding a guanosine at the 5' end, preferably by 5' truncating the sequence until the 5' end is a guanosine or by changing the first base to a guanosine, especially by 5' truncating the sequence until the 5' end is a guanosine.

Having as the first base a guanosine allows efficient transcription by T7 polymerase. Preferably, this method step is performed computer-implemented with a software.

I) optionally modifying at least one of the artificial transcript sequences of the set so that the set of the artificial transcript sequences has essentially randomly distributed occurrences of 5' start trinucleotides selected from GAA, GAC, GAG, GAT, GCA, GCC, GCG, GCT, GGA, GGC, GGG, GGT, GTA, GTC, GTG, GTT or of 5' start dinucleotides selected from AA, AC, AG, AT, CA, CC, CG, CT, GA, GC, GG, GT, TA, TC, TG, TT and/or of 3' end dinucleotides selected from AC, AG, AT, CC, CG, CT, GC, GG, GT, TC, TG, TT. Preferably, this method step is performed computer-implemented with a software. This makes the produced reference set compatible and especially suitable for the complexity reduction method described in WO 2011/095501 A1.

Herein, as well as in the context of the entire invention, having "essentially randomly distributed occurrences" (for the purposes of the present invention), which may be "essentially uniform distributed occurrences", means that—when applying the widely used chi-squared test (as developed by Pearson) to the occurrences, with the discrete uniform distribution (i.e. every event is equally likely) as fitted distribution—the resulting p value (typically tabulated against the chi-square value) is higher than 0.1, preferably higher than 0.2, more preferably higher than 0.3, even more preferably higher than 0.5, especially higher than 0.8. How to apply the chi-square test is well-known in the art. See also Example 4 on how to apply the chisquared test.

J) preferably adding a poly(A) tail sequence to one or more, preferably all, of the artificial transcript sequences of the set, preferably consisting of at least 10, especially at least 20, adenosines. Preferably, this method step is performed computer-implemented with a software. Optionally, an index sequence (DNA barcode or sequence label) after the poly(A) tail is added to one or more, preferably all, of the artificial transcript sequences of the set. The index sequence enables alternative quantification and validation methods during the preparation of reference sets but needs to be blinded out during the application as reference set. The blind out can be achieved by placing the index sequence beyond the poly-tail which is either not seen by the particular succeeding workflow (RNA sequencing protocol including a poly(A) priming) or the indexing sequence must be masked in any potential reads and in the reference annotation. Preferably, this method step is performed computer-implemented with a software K) or preferably any combinations of at least two of steps E-J, preferably wherein each method step is performed only once; and L) for each artificial transcript sequence of the set: physically synthesizing an NA molecule comprising the entire artificial transcript sequence. It is known in the art how to synthesize NA, especially DNA and RNA, molecules. DNA and RNA can be produced by in-vivo (expressed in recombinant cells, e.g. *E. coli*) or in-vitro biochemical methods (e.g. synthesis/amplification by DNA/RNA polymerases, e.g. polymerase chain reaction—PCR), as well as chemically synthesized. If the artificial NA is DNA, it is preferably synthesized by de-novo DNA synthesis and amplified by PCR. Amplification in vivo by cloning into a plasmid, transformation into an microorganism, sequence-verification and growing of the transformed microorganism is also possible. From the DNA template, it is possible to synthesise RNA by transcription with T7 RNA polymerase. Preferably, if the NA is RNA, it is transcribed from DNA, especially by T7 RNA polymerase;

M) preferably, if an NA molecule of step L) is an RNA molecule, physically adding a 5'Cap-structure to the RNA molecule. This achieves an even closer simulation of actual eukaryotic transcripts. Capping of mRNAs can be performed enzymatically, for instance by the Vaccinia Capping System (New England BioLabs, Inc.). See also e.g. WO 2009/058911 A2;

thereby physically obtaining a reference set of artificial NA molecules simulating transcript variants, preferably being a reference set of RNA or of DNA molecules.

In a preferred embodiment, steps D)-G), preferably all steps, are performed with the proviso that the reference set of artificial NA molecules shall simulate alternative transcription events that occur in nature for eukaryote genes, preferably for animal or plant genes, more preferably for vertebrate genes, even more preferably for mammalian genes, especially for human genes, and said events are preferably selected from the group of:

alternative transcript start sites (TSS), alternative transcript end sites (TES), antisense transcripts, overlapping transcripts, and alternative splicing events selected from the group of skipped cassette exon (CE), intron retention (IR), mutually exlusive exons (MXE), alternative 3' splice sites (A3SS), alternatives 5' splice sites (A5SS), alternative first exon (AFE), alternative last exon (ALE) and trans-splicing.

In another preferred embodiment, the reference set of artificial NA molecules simulates at least one, preferably at least two, more preferably at least three, even more preferably at least five, especially all alternative transcription events selected from the group of:

alternative transcript start sites (TSS), alternative transcript end sites (TES), antisense transcripts, overlapping transcripts, and alternative splicing events selected from the group of skipped cassette exon (CE), intron retention (IR), mutually exlusive exons (MXE), alternative 3' splice sites (A3SS), alternatives 5' splice sites (A5SS), alternative first exon (AFE), alternative last exon (ALE) and trans-splicing.

In another preferred embodiment, at least 50%, preferably at least 75%, especially at least 95% of all intron start dinucleotides within all exon sequences of the reference set of artificial NA molecules are GT, wherein each of said intron start dinucleotides is a 5' terminal dinucleotide of a sequence that is not present in another artificial NA molecule of the reference set and thereby represents an intron for said another artificial NA molecule, and/or (preferably "and") at least 50%, preferably at least 75%, especially at least 95% of all intron end dinucleotides within all exon sequences of the reference set of artificial NA molecules are AT, wherein each of said intron end dinucleotides is a 5' terminal dinucleotide of a sequence that is not present in another artificial NA molecule of the reference set and thereby represents an intron for said another artificial NA molecule.

In another preferred embodiment, the reference set of artificial NA molecules has a mean sequence length of 500 nt to 2000 nt, preferably 750 nt to 1500 nt, especially of 1000 nt to 1400 nt; and preferably with a standard deviation of 300 nt to 1200 nt, preferably 600 nt to 900 nt, especially 700 nt to 800 nt; with a minimum size of at least 100 nt; and preferably with a maximum size of 10000 nt.

In another preferred embodiment, the reference set of the artificial NA molecules has essentially randomly distributed occurrences of 5' start trinucleotides selected from GAA, GAC, GAG, GAT, GCA, GCC, GCG, GCT, GGA, GGC, GGG, GGT, GTA, GTC, GTG, GTT or of 5' start dinucleotides selected from AA, AC, AG, AT, CA, CC, CG, CT, GA, GC, GG, GT, TA, TC, TG, TT and/or of 3' end dinucleotides selected from AC, AG, AT, CC, CG, CT, GC, GG, GT, TC, TG, TT. This makes the produced reference set especially suitable for the complexity reduction method described in WO 2011/095501 A1.

In another preferred embodiment, at least 50%, preferably all, artificial NA molecules of the reference set have an average GC content from 25% to 55%. Preferably, the average GC content is selected to be the same as the average GC content of transcripts of the species (or phylogenetic group) the naturally-occurring genes are selected from.

In another preferred embodiment, each artificial NA molecule of the reference set has a guanosine as 5' start nucleotide.

In another preferred embodiment, at least one, preferably each, of the artificial NA molecules of the reference set, if it is an RNA molecule, has a 5'-cap structure In another preferred embodiment, the method further comprises providing the reference set of artificial NA molecules wherein at least two, preferably each, of the NA molecules of the reference set are present in a preset molar amount, preferably in the same container. Beneficially, it is provided in the form of a kit ready for use. Preferably, the respective molar amounts of at least two of the NA molecules differ by the order of at least two magnitudes, preferably at least three magnitudes, more preferably at least five magnitudes, especially at least six magnitudes, and in particular wherein the at least two of the NA molecules are provided dissolved in liquid or ready to dissolve or dilute in liquid wherein their respective concentrations or final concentrations range between 0.01 attomoles/µl and 100 femtomoles/µl, or between 100 zeptomoles/µl and 1 femtomole/µl.

As discussed above, stabilisation and reduction of handling errors is important. Therefore, in a highly preferred embodiment, the inventive method comprises the step of drying, preferably freeze-drying, the physically obtained reference set, preferably in a container, preferably together with stabilising agents.

In another preferred embodiment, the sequences of the reference set of artificial NA molecules do not have similarity to sequences whose NCBI GenBank database accession numbers are listed in Table 3 (i.e. do not have similarity to most known eukaryotic sequences), preferably in any one of Table 3 and Table (i.e. do not have similarity to both most known eukaryotic and most known prokaryotic/viral sequences), especially to all sequences of NCBI GenBank database release 202 of 15 Jun. 2014, with a statistical significance threshold (Expect threshold) of less than $10^{-1}$, preferably less than 1, especially less than 10. The similarity is determined by the BLASTn programme with the following parameters: word size of 28, with filtering low complexity regions, linear gap costs and match/mismatch scores of 1,−2. See Karlin & Altschul, 1990, for an explanation of the statistical significance threshold, and Benson et al., 2013, for an introduction to GenBank. This embodiment is exceptionally well-suited to solve a problem of the present invention because it allows unambiguous identification of sequences (provided they have a minimum length of e.g. 30 nt, which is easily achievable for instance by RNA-seq) of the reference set, even when it is added to a complex sample. The current GenBank version is freely available for download under: ftp://ftp.ncbi.nlm.nih.gov/genbank/, the BLAST software is freely available for download under:

ftp://ftp.ncbi.nlm.nih.gov/blast/executables/blast+/. Easy-to-use BLAST search of GenBank is also possible on http://blast.ncbi.nlm.nih.gov/Blast.cgi (nucleotide blast, selected database nucleotide collection (nr/nt), highly similar sequences (megablast)).

The present invention also provides a reference set of artificial NA molecules simulating transcript variants, obtainable by any embodiment of the above method of the invention (in particular by the embodiments explicitly mentioned herein).

TABLE 3

GenBank accession numbers of published animal or plant chromosome sequences (including entry version number ".N"; GenBank database release 202, 15 Jun. 2014)

| | | | | | |
|---|---|---|---|---|---|
| AAAA00000000.2 | CM000247.2 | CM001262.1 | CM002663.1 | NC_006468.3 | NC_015778.1 |
| AAAB00000000.1 | CM000248.2 | CM001263.1 | CM002664.1 | NC_006469.3 | NC_015779.1 |
| AABR00000000.6 | CM000249.2 | CM001264.1 | CM002665.1 | NC_006470.3 | NC_015867.2 |
| AABS00000000.1 | CM000250.2 | CM001265.1 | CM002666.1 | NC_006471.3 | NC_015868.2 |
| AABU00000000.1 | CM000251.2 | CM001266.1 | CM002667.1 | NC_006472.3 | NC_015869.2 |
| AACN00000000.1 | CM000276.2 | CM001267.1 | CM002668.1 | NC_006473.3 | NC_015870.2 |
| AACV00000000.1 | CM000277.2 | CM001268.1 | CM002669.1 | NC_006474.3 | NC_015871.2 |
| AACZ00000000.3 | CM000278.2 | CM001269.1 | CM002670.1 | NC_006475.3 | NC_016089.1 |
| AADA00000000.1 | CM000279.1 | CM001270.1 | CM002671.1 | NC_006476.3 | NC_016090.1 |
| AADC00000000.1 | CM000280.2 | CM001271.1 | CM002672.1 | NC_006477.3 | NC_016091.1 |
| AADD00000000.1 | CM000281.2 | CM001272.1 | CM002693.1 | NC_006478.3 | NC_016093.1 |
| AADE00000000.1 | CM000282.2 | CM001273.1 | CM002694.1 | NC_006479.3 | NC_016099.1 |
| AADG00000000.6 | CM000283.2 | CM001276.1 | CM002706.1 | NC_006480.3 | NC_016100.1 |
| AADN00000000.3 | CM000284.2 | CM001277.1 | CM002707.1 | NC_006481.3 | NC_016105.1 |
| AAEU00000000.2 | CM000285.2 | CM001278.1 | CM002708.1 | NC_006482.3 | NC_016118.1 |
| AAEX00000000.3 | CM000288.1 | CM001279.1 | CM002709.1 | NC_006483.3 | NC_016125.1 |
| AAFC00000000.3 | CM000289.1 | CM001280.1 | CM002710.1 | NC_006484.3 | NC_016131.1 |
| AAFR00000000.3 | CM000290.1 | CM001281.1 | CM002711.1 | NC_006485.3 | NC_016132.1 |
| AAFS00000000.1 | CM000291.1 | CM001282.1 | CM002712.1 | NC_006486.3 | NC_016133.1 |
| AAGH00000000.1 | CM000292.1 | CM001283.1 | CM002713.1 | NC_006487.3 | NC_016134.1 |
| AAGL00000000.1 | CM000293.1 | CM001284.1 | CM002714.1 | NC_006488.2 | NC_016135.1 |
| AAGM00000000.1 | CM000294.1 | CM001285.1 | CM002715.1 | NC_006489.3 | NC_016145.1 |
| AAGN00000000.1 | CM000295.1 | CM001286.1 | CM002716.1 | NC_006490.3 | NC_016407.1 |
| AAGW00000000.2 | CM000296.1 | CM001287.1 | CM002717.1 | NC_006491.3 | NC_016408.1 |
| AAHX00000000.1 | CM000297.1 | CM001288.1 | CM002718.1 | NC_006492.3 | NC_016409.1 |
| AAHY00000000.1 | CM000298.1 | CM001289.1 | CM002719.1 | NC_006583.3 | NC_016410.1 |
| AAJJ00000000.1 | CM000299.1 | CM001290.1 | CM002720.1 | NC_006584.3 | NC_016411.1 |
| AANG00000000.2 | CM000300.1 | CM001291.1 | CM002721.1 | NC_006585.3 | NC_016412.1 |
| AANI00000000.1 | CM000301.1 | CM001292.1 | CM002722.1 | NC_006586.3 | NC_016413.1 |
| AANU00000000.1 | CM000302.1 | CM001293.1 | CM002723.1 | NC_006587.3 | NC_016414.1 |
| AAPN00000000.1 | CM000303.1 | CM001294.1 | CM002724.1 | NC_006588.3 | NC_016433.2 |
| AASR00000000.1 | CM000304.1 | CM001295.1 | CM002725.1 | NC_006589.3 | NC_016668.1 |
| AASS00000000.1 | CM000305.1 | CM001296.1 | CM002726.1 | NC_006590.3 | NC_016734.1 |
| AAST00000000.1 | CM000306.1 | CM001378.1 | CM002727.1 | NC_006591.3 | NC_016927.1 |
| AASU00000000.1 | CM000307.1 | CM001379.1 | CM002728.1 | NC_006592.3 | NC_017602.1 |
| AASV00000000.1 | CM000308.1 | CM001380.1 | CM002729.1 | NC_006593.3 | NC_017835.1 |
| AASW00000000.1 | CM000314.2 | CM001381.1 | CM002730.1 | NC_006594.3 | NC_017929.1 |
| AAWR00000000.2 | CM000315.2 | CM001382.1 | CM002731.1 | NC_006595.3 | NC_018152.1 |
| AAWZ00000000.2 | CM000316.2 | CM001383.1 | CM002732.1 | NC_006596.3 | NC_018153.1 |
| AAXL00000000.1 | CM000317.2 | CM001384.1 | CM002733.1 | NC_006597.3 | NC_018154.1 |
| AAXM00000000.1 | CM000318.2 | CM001385.1 | CM002734.1 | NC_006598.3 | NC_018155.1 |
| AAXN00000000.1 | CM000319.2 | CM001386.1 | CM002735.1 | NC_006599.3 | NC_018156.1 |
| AAXO00000000.1 | CM000320.2 | CM001387.1 | CM002736.1 | NC_006600.3 | NC_018157.1 |
| AAXP00000000.1 | CM000321.3 | CM001388.1 | CM002737.1 | NC_006601.3 | NC_018158.1 |
| AAZX00000000.1 | CM000322.3 | CM001389.1 | CM002738.1 | NC_006602.3 | NC_018159.1 |
| AB042240.3 | CM000323.2 | CM001390.1 | CM002739.1 | NC_006603.3 | NC_018160.1 |
| AB042432.1 | CM000324.2 | CM001391.1 | CM002740.1 | NC_006604.3 | NC_018161.1 |
| AB042861.1 | CM000325.2 | CM001392.1 | CM002741.1 | NC_006605.3 | NC_018162.1 |
| AB073400.1 | CM000326.2 | CM001393.1 | CM002742.1 | NC_006606.3 | NC_018163.1 |
| ABBA00000000.1 | CM000327.2 | CM001394.1 | CM002743.1 | NC_006607.3 | NC_018164.1 |
| ABGA00000000.1 | CM000328.2 | CM001395.1 | CM002744.1 | NC_006608.3 | NC_018165.1 |
| ABKP00000000.2 | CM000329.2 | CM001396.1 | CM002745.1 | NC_006609.3 | NC_018166.1 |
| ABKQ00000000.2 | CM000330.2 | CM001404.1 | CM002746.1 | NC_006610.3 | NC_018167.1 |
| ABKV00000000.1 | CM000331.2 | CM001405.1 | CM002747.1 | NC_006611.3 | NC_018168.1 |
| ABQF00000000.1 | CM000332.2 | CM001406.1 | CM002748.1 | NC_006612.3 | NC_018169.1 |

TABLE 3-continued

GenBank accession numbers of published animal or
plant chromosome sequences (including entry version number ".N";
GenBank database release 202, 15 Jun. 2014)

| | | | | | |
|---|---|---|---|---|---|
| ABRL00000000.2 | CM000333.2 | CM001407.1 | CM002759.1 | NC_006613.3 | NC_018170.1 |
| ABSL00000000.1 | CM000334.3 | CM001408.1 | CM002760.1 | NC_006614.3 | NC_018171.1 |
| ABXC00000000.1 | CM000335.2 | CM001409.1 | CM002761.1 | NC_006615.3 | NC_018172.1 |
| AC_000023.1 | CM000336.2 | CM001410.1 | CM002762.1 | NC_006616.3 | NC_018348.1 |
| AC_000024.1 | CM000356.1 | CM001411.1 | CM002763.1 | NC_006617.3 | NC_018424.1 |
| AC_000025.1 | CM000357.1 | CM001412.1 | CM002764.1 | NC_006618.3 | NC_018425.1 |
| AC_000026.1 | CM000358.1 | CM001413.1 | CM002765.1 | NC_006619.3 | NC_018426.1 |
| AC_000027.1 | CM000359.1 | CM001414.1 | CM002766.1 | NC_006620.3 | NC_018427.1 |
| AC_000028.1 | CM000360.1 | CM001415.1 | CM002767.1 | NC_006621.3 | NC_018428.1 |
| AC_000029.1 | CM000361.1 | CM001416.1 | CM002768.1 | NC_006853.1 | NC_018429.1 |
| AC_000030.1 | CM000362.1 | CM001417.1 | CM002769.1 | NC_006914.1 | NC_018430.1 |
| AC_000031.1 | CM000363.1 | CM001418.1 | CM002770.1 | NC_006915.1 | NC_018431.1 |
| AC_000032.1 | CM000364.1 | CM001419.1 | CM002771.1 | NC_007070.3 | NC_018432.1 |
| AC_000033.1 | CM000365.1 | CM001420.1 | CM002772.1 | NC_007071.3 | NC_018433.1 |
| AC_000034.1 | CM000366.1 | CM001421.1 | CM002773.1 | NC_007072.3 | NC_018434.1 |
| AC_000035.1 | CM000367.2 | CM001422.1 | CM002774.1 | NC_007073.3 | NC_018435.1 |
| AC_000036.1 | CM000368.1 | CM001423.1 | CM002775.1 | NC_007074.3 | NC_018436.1 |
| AC_000037.1 | CM000369.1 | CM001424.1 | CM002776.1 | NC_007075.3 | NC_018437.1 |
| AC_000038.1 | CM000370.1 | CM001425.1 | CM002777.1 | NC_007076.3 | NC_018438.1 |
| AC_000039.1 | CM000371.1 | CM001426.1 | CM002784.1 | NC_007077.3 | NC_018439.1 |
| AC_000040.1 | CM000372.1 | CM001427.1 | CM002785.1 | NC_007078.3 | NC_018440.1 |
| AC_000041.1 | CM000373.1 | CM001428.1 | CM002786.1 | NC_007079.3 | NC_018441.1 |
| AC_000042.1 | CM000374.1 | CM001429.1 | CM002787.1 | NC_007080.3 | NC_018442.1 |
| AC_000043.1 | CM000375.1 | CM001430.1 | CM002788.1 | NC_007081.3 | NC_018443.1 |
| AC_000068.1 | CM000376.1 | CM001431.1 | CM002789.1 | NC_007082.3 | NC_018444.1 |
| AC_000069.1 | CM000377.2 | CM001432.1 | CM002790.1 | NC_007083.3 | NC_018445.1 |
| AC_000070.1 | CM000378.2 | CM001444.1 | CM002791.1 | NC_007084.3 | NC_018446.1 |
| AC_000071.1 | CM000379.2 | CM001445.1 | CM002792.1 | NC_007085.3 | NC_018447.1 |
| AC_000072.1 | CM000380.2 | CM001446.1 | CM002797.1 | NC_007112.5 | NC_018554.1 |
| AC_000073.1 | CM000381.2 | CM001447.1 | CP000581.1 | NC_007113.5 | NC_018723.1 |
| AC_000074.1 | CM000382.2 | CM001448.1 | CP000582.1 | NC_007114.5 | NC_018724.1 |
| AC_000075.1 | CM000383.2 | CM001449.1 | CP000583.1 | NC_007115.5 | NC_018725.1 |
| AC_000076.1 | CM000384.2 | CM001450.1 | CP000584.1 | NC_007116.5 | NC_018726.1 |
| AC_000077.1 | CM000385.2 | CM001451.1 | CP000585.1 | NC_007117.5 | NC_018727.1 |
| AC_000078.1 | CM000386.2 | CM001452.1 | CP000586.1 | NC_007118.5 | NC_018728.1 |
| AC_000079.1 | CM000387.2 | CM001453.1 | CP000587.1 | NC_007119.5 | NC_018729.1 |
| AC_000080.1 | CM000388.2 | CM001454.1 | CP000588.1 | NC_007120.5 | NC_018730.1 |
| AC_000081.1 | CM000389.2 | CM001455.1 | CP000589.1 | NC_007121.5 | NC_018731.1 |
| AC_000082.1 | CM000390.2 | CM001456.1 | CP000590.1 | NC_007122.5 | NC_018732.1 |
| AC_000083.1 | CM000391.2 | CM001457.1 | CP000591.1 | NC_007123.5 | NC_018733.1 |
| AC_000084.1 | CM000392.2 | CM001458.1 | CP000592.1 | NC_007124.5 | NC_018734.1 |
| AC_000085.1 | CM000393.2 | CM001459.1 | CP000593.1 | NC_007125.5 | NC_018735.1 |
| AC_000086.1 | CM000394.2 | CM001460.1 | CP000594.1 | NC_007126.5 | NC_018736.1 |
| AC_000087.1 | CM000395.2 | CM001461.1 | CP000595.1 | NC_007127.5 | NC_018737.1 |
| AC_000088.1 | CM000396.2 | CM001462.1 | CP000596.1 | NC_007128.5 | NC_018738.1 |
| AC_000089.1 | CM000397.2 | CM001463.1 | CP000597.1 | NC_007129.5 | NC_018739.1 |
| AC_000092.1 | CM000398.2 | CM001464.1 | CP000598.1 | NC_007130.5 | NC_018740.1 |
| AC_000133.1 | CM000399.2 | CM001465.1 | CP000599.1 | NC_007131.5 | NC_018741.1 |
| AC_000134.1 | CM000400.2 | CM001491.1 | CP000600.1 | NC_007132.5 | NC_018766.1 |
| AC_000135.1 | CM000401.2 | CM001492.1 | CP000601.1 | NC_007133.5 | NC_018890.1 |
| AC_000136.1 | CM000402.2 | CM001493.1 | CP001323.1 | NC_007134.5 | NC_018891.1 |
| AC_000137.1 | CM000403.2 | CM001494.1 | CP001324.1 | NC_007135.5 | NC_018892.1 |
| AC_000138.1 | CM000404.2 | CM001495.1 | CP001325.1 | NC_007136.5 | NC_018893.1 |
| AC_000139.1 | CM000405.2 | CM001496.1 | CP001326.1 | NC_007235.1 | NC_018894.1 |
| AC_000140.1 | CM000406.2 | CM001497.1 | CP001327.1 | NC_007236.1 | NC_018895.1 |
| AC_000141.1 | CM000407.2 | CM001498.1 | CP001328.1 | NC_007237.1 | NC_018896.1 |
| AC_000142.1 | CM000408.2 | CM001499.1 | CP001329.1 | NC_007299.5 | NC_018897.1 |
| AC_000143.1 | CM000409.1 | CM001500.1 | CP001330.1 | NC_007300.5 | NC_018898.1 |
| AC_000144.1 | CM000410.1 | CM001501.1 | CP001331.1 | NC_007301.5 | NC_018899.1 |
| AC_000145.1 | CM000411.1 | CM001502.1 | CP001332.1 | NC_007302.5 | NC_018900.1 |
| AC_000146.1 | CM000412.1 | CM001503.1 | CP001333.1 | NC_007303.5 | NC_018901.1 |
| AC_000147.1 | CM000413.1 | CM001504.1 | CP001334.1 | NC_007304.5 | NC_018902.1 |
| AC_000148.1 | CM000414.1 | CM001505.1 | CP001335.1 | NC_007305.5 | NC_018903.1 |
| AC_000149.1 | CM000415.1 | CM001506.1 | CP001574.1 | NC_007306.5 | NC_018904.1 |
| AC_000150.1 | CM000416.1 | CM001507.1 | CP001575.1 | NC_007307.5 | NC_018905.1 |
| AC_000151.1 | CM000417.1 | CM001508.1 | CP001576.1 | NC_007308.5 | NC_018906.1 |
| AC_000152.1 | CM000418.1 | CM001509.1 | CP001577.1 | NC_007309.5 | NC_018907.1 |
| AC_000153.1 | CM000419.1 | CM001510.1 | CP002684.1 | NC_007310.5 | NC_018908.1 |
| AC_000154.1 | CM000420.1 | CM001511.1 | CP002685.1 | NC_007311.5 | NC_018909.1 |
| AC_000155.1 | CM000421.1 | CM001516.2 | CP002686.1 | NC_007312.5 | NC_018910.1 |
| AC_000156.1 | CM000422.1 | CM001517.2 | CP002687.1 | NC_007313.5 | NC_018911.1 |
| AC_000158.1 | CM000423.1 | CM001518.2 | CP002688.1 | NC_007314.4 | NC_018912.2 |
| AC_000159.1 | CM000424.1 | CM001519.2 | CR954199.2 | NC_007315.5 | NC_018913.2 |
| AC_000160.1 | CM000425.1 | CM001520.2 | CR954200.2 | NC_007316.5 | NC_018914.2 |
| AC_000161.1 | CM000426.1 | CM001521.2 | CU651604.3 | NC_007317.5 | NC_018915.2 |
| AC_000162.1 | CM000427.1 | CM001582.1 | CU651605.3 | NC_007318.5 | NC_018916.2 |

TABLE 3-continued

GenBank accession numbers of published animal or plant chromosome sequences (including entry version number ".N"; GenBank database release 202, 15 Jun. 2014)

| | | | | | |
|---|---|---|---|---|---|
| AC_000163.1 | CM000462.1 | CM001583.1 | CU651606.3 | NC_007319.5 | NC_018917.2 |
| AC_000164.1 | CM000463.1 | CM001584.1 | CU651607.3 | NC_007320.5 | NC_018918.2 |
| AC_000165.1 | CM000464.1 | CM001585.1 | CU651608.3 | NC_007324.5 | NC_018919.2 |
| AC_000166.1 | CM000465.1 | CM001586.1 | CU651609.3 | NC_007325.5 | NC_018920.2 |
| AC_000167.1 | CM000466.1 | CM001587.1 | CU651610.3 | NC_007326.5 | NC_018921.2 |
| AC_000168.1 | CM000467.1 | CM001588.1 | CU651611.3 | NC_007327.5 | NC_018922.2 |
| AC_000169.1 | CM000468.1 | CM001589.1 | CU651612.3 | NC_007328.4 | NC_018923.2 |
| AC_000170.1 | CM000469.1 | CM001590.1 | CU651613.3 | NC_007329.5 | NC_018924.2 |
| AC_000171.1 | CM000470.1 | CM001591.1 | CU651614.3 | NC_007330.5 | NC_018925.2 |
| AC_000172.1 | CM000471.1 | CM001592.1 | CU651615.3 | NC_007331.4 | NC_018926.2 |
| AC_000173.1 | CM000472.1 | CM001593.1 | CU651616.3 | NC_007416.2 | NC_018927.2 |
| AC_000174.1 | CM000473.1 | CM001594.1 | CU651617.3 | NC_007417.2 | NC_018928.2 |
| AC_000175.1 | CM000474.1 | CM001595.1 | CU651618.3 | NC_007418.2 | NC_018929.2 |
| AC_000176.1 | CM000475.1 | CM001596.1 | CU651619.3 | NC_007419.1 | NC_018930.2 |
| AC_000177.1 | CM000476.1 | CM001597.1 | CU651620.3 | NC_007420.2 | NC_018931.2 |
| AC_000178.1 | CM000477.1 | CM001598.1 | CU651621.3 | NC_007421.2 | NC_018932.2 |
| AC_000179.1 | CM000478.1 | CM001599.1 | CU651622.3 | NC_007422.4 | NC_018933.2 |
| AC_000180.1 | CM000479.1 | CM001600.1 | CU651623.3 | NC_007423.2 | NC_018934.2 |
| AC_000181.1 | CM000480.1 | CM001601.1 | CU651624.3 | NC_007424.2 | NC_019458.1 |
| AC_000182.1 | CM000481.1 | CM001602.1 | CU651625.3 | NC_007425.2 | NC_019461.1 |
| AC_000183.1 | CM000482.1 | CM001603.1 | CU651626.3 | NC_007579.1 | NC_019462.1 |
| AC_000184.1 | CM000483.1 | CM001604.1 | CU651627.3 | NC_007858.1 | NC_019464.1 |
| AC_000185.1 | CM000484.1 | CM001605.1 | CU651628.3 | NC_007859.1 | NC_019465.1 |
| AC_000186.1 | CM000485.1 | CM001606.1 | D00293.1 | NC_007860.1 | NC_019468.1 |
| AC_000187.1 | CM000491.1 | CM001607.1 | D00564.1 | NC_007861.1 | NC_019470.1 |
| AC_000188.1 | CM000492.1 | CM001608.1 | D38113.1 | NC_007862.1 | NC_019471.1 |
| AC024175.3 | CM000493.1 | CM001609.2 | D38114.1 | NC_007863.1 | NC_019472.1 |
| AC093544.8 | CM000494.1 | CM001610.2 | DAAA00000000.2 | NC_007864.1 | NC_019474.1 |
| ACBE00000000.1 | CM000495.1 | CM001611.2 | DAAB00000000.1 | NC_007865.1 | NC_019475.1 |
| ACFV00000000.1 | CM000496.1 | CM001612.2 | DG000001.5 | NC_007866.1 | NC_019477.1 |
| ACIV00000000.1 | CM000497.1 | CM001613.2 | DG000002.5 | NC_007867.1 | NC_019480.1 |
| ACUP00000000.1 | CM000498.1 | CM001614.2 | DG000003.5 | NC_007868.1 | NC_019481.1 |
| ACYM00000000.1 | CM000499.1 | CM001615.2 | DG000004.5 | NC_007869.1 | NC_019483.1 |
| ADDD00000000.1 | CM000500.1 | CM001616.2 | DG000005.5 | NC_007870.1 | NC_019484.1 |
| ADDF00000000.2 | CM000501.1 | CM001617.2 | DG000006.5 | NC_007871.1 | NC_019816.1 |
| ADDN00000000.1 | CM000502.1 | CM001618.2 | DG000007.5 | NC_007872.1 | NC_019817.1 |
| ADFV00000000.1 | CM000503.1 | CM001619.2 | DG000008.5 | NC_007873.1 | NC_019818.1 |
| AE005172.1 | CM000504.1 | CM001620.2 | DG000009.5 | NC_007874.1 | NC_019819.1 |
| AE005173.1 | CM000505.1 | CM001621.2 | DG000010.5 | NC_007875.1 | NC_019820.1 |
| AE013599.4 | CM000506.1 | CM001622.2 | DG000011.5 | NC_007876.1 | NC_019821.1 |
| AE014134.5 | CM000507.1 | CM001623.2 | DG000012.5 | NC_007877.1 | NC_019822.1 |
| AE014135.3 | CM000508.1 | CM001624.2 | DG000013.5 | NC_007878.1 | NC_019823.1 |
| AE014296.4 | CM000509.1 | CM001625.2 | DG000014.5 | NC_007886.1 | NC_019824.1 |
| AE014297.2 | CM000510.1 | CM001626.2 | DG000015.5 | NC_007897.1 | NC_019825.1 |
| AE014298.4 | CM000511.1 | CM001627.2 | DG000016.5 | NC_007898.3 | NC_019826.1 |
| AECO00000000.1 | CM000512.1 | CM001628.2 | DG000017.5 | NC_007942.1 | NC_019827.1 |
| AEHK00000000.1 | CM000513.1 | CM001629.2 | DG000018.5 | NC_007957.1 | NC_019828.1 |
| AEHL00000000.1 | CM000514.1 | CM001630.2 | DG000019.5 | NC_007982.1 | NC_019829.1 |
| AEKE00000000.2 | CM000515.1 | CM001631.2 | DG000020.5 | NC_008066.1 | NC_019830.1 |
| AEKP00000000.1 | CM000516.1 | CM001634.1 | DG000021.5 | NC_008155.1 | NC_019831.1 |
| AEKQ00000000.2 | CM000517.1 | CM001635.1 | DG000022.5 | NC_008285.1 | NC_019832.1 |
| AEKR00000000.1 | CM000518.1 | CM001636.1 | DG000023.5 | NC_008289.1 | NC_019833.1 |
| AELG00000000.1 | CM000519.1 | CM001637.1 | DG000024.5 | NC_008290.1 | NC_019834.1 |
| AEMH00000000.1 | CM000520.1 | CM001638.1 | DG000025.1 | NC_008332.1 | NC_019835.1 |
| AEMK00000000.1 | CM000521.1 | CM001639.1 | DG000026.1 | NC_008334.1 | NC_019836.1 |
| AENI00000000.1 | CM000522.1 | CM001640.1 | DG000027.1 | NC_008360.1 | NC_019837.1 |
| AEOM00000000.1 | CM000523.1 | CM001641.1 | DG000028.1 | NC_008394.4 | NC_019838.1 |
| AERX00000000.1 | CM000524.1 | CM001642.1 | DG000029.1 | NC_008395.2 | NC_019839.1 |
| AF010406.1 | CM000525.1 | CM001643.1 | DG000030.1 | NC_008396.2 | NC_019840.1 |
| AF034253.1 | CM000526.1 | CM001646.1 | DG000031.1 | NC_008397.2 | NC_019841.1 |
| AF200833.1 | CM000527.1 | CM001647.1 | DG000032.1 | NC_008398.2 | NC_019859.1 |
| AF216698.1 | CM000528.1 | CM001648.1 | DG000033.1 | NC_008399.2 | NC_019860.1 |
| AFAN00000000.1 | CM000529.1 | CM001649.1 | DG000034.1 | NC_008400.2 | NC_019861.1 |
| AFMZ00000000.1 | CM000530.1 | CM001650.1 | DG000035.1 | NC_008401.2 | NC_019862.1 |
| AFNA00000000.1 | CM000531.1 | CM001651.1 | DG000036.1 | NC_008402.2 | NC_019863.1 |
| AFNB00000000.1 | CM000532.1 | CM001652.1 | DG000053.1 | NC_008403.2 | NC_019864.1 |
| AFNC00000000.1 | CM000533.1 | CM001653.1 | DG000054.1 | NC_008404.2 | NC_019865.1 |
| AFYB00000000.1 | CM000534.1 | CM001654.1 | DG000055.1 | NC_008405.2 | NC_019866.1 |
| AGAT00000000.1 | CM000535.1 | CM001655.1 | DG000056.1 | NC_008465.2 | NC_019867.1 |
| AGRG00000000.1 | CM000536.1 | CM001656.1 | DG000057.1 | NC_008466.2 | NC_019868.1 |
| AGTO00000000.2 | CM000537.1 | CM001657.1 | DG000058.1 | NC_008602.1 | NC_019869.1 |
| AHAO00000000.1 | CM000538.1 | CM001658.1 | DG000059.1 | NC_008801.1 | NC_019870.1 |
| AHAP00000000.1 | CM000539.1 | CM001659.1 | DG000060.1 | NC_008802.1 | NC_019871.1 |
| AHAQ00000000.1 | CM000540.1 | CM001660.1 | DG000061.1 | NC_008803.1 | NC_019872.1 |
| AHAT00000000.1 | CM000541.1 | CM001661.1 | DG000062.1 | NC_008804.1 | NC_019873.1 |
| AHBB00000000.1 | CM000542.1 | CM001662.1 | DG000063.1 | NC_008805.1 | NC_019874.1 |

TABLE 3-continued

GenBank accession numbers of published animal or plant chromosome sequences (including entry version number ".N"; GenBank database release 202, 15 Jun. 2014)

| | | | | | |
|---|---|---|---|---|---|
| AHGY00000000.2 | CM000543.1 | CM001663.1 | DG000064.1 | NC_008806.1 | NC_019875.1 |
| AHID00000000.1 | CM000544.1 | CM001664.1 | DP000054.2 | NC_008807.1 | NC_019876.1 |
| AHII00000000.1 | CM000545.1 | CM001665.1 | DQ069713.1 | NC_008808.1 | NC_019877.1 |
| AHIU00000000.1 | CM000546.1 | CM001666.1 | DQ167399.1 | NC_008809.1 | NC_019878.1 |
| AHZW00000000.1 | CM000547.1 | CM001667.1 | DQ231548.1 | NC_009005.2 | NC_019879.1 |
| AHZZ00000000.1 | CM000548.1 | CM001668.1 | DQ317523.1 | NC_009006.2 | NC_019880.1 |
| AJ002189.1 | CM000549.1 | CM001669.1 | DQ347959.1 | NC_009094.1 | NC_019881.1 |
| AJ270058.1 | CM000550.1 | CM001670.1 | DQ422742.1 | NC_009095.1 | NC_019882.1 |
| AJ270060.1 | CM000551.1 | CM001671.1 | DQ424856.1 | NC_009096.1 | NC_020006.2 |
| AJ312413.2 | CM000552.1 | CM001672.1 | DQ645539.1 | NC_009097.1 | NC_020167.1 |
| AJ421455.1 | CM000553.1 | CM001673.1 | DQ864733.1 | NC_009098.1 | NC_020171.1 |
| AJ508398.1 | CM000554.1 | CM001674.1 | DQ874614.2 | NC_009099.1 | NC_020176.1 |
| AJ517314.2 | CM000555.1 | CM001675.1 | DQ886273.1 | NC_009100.1 | NC_020177.1 |
| AJKK00000000.1 | CM000556.1 | CM001676.1 | DQ984518.1 | NC_009103.1 | NC_020178.1 |
| AJMI00000000.2 | CM000557.1 | CM001677.1 | EAAA00000000.1 | NC_009104.1 | NC_020455.1 |
| AJPS00000000.1 | CM000558.1 | CM001678.1 | EF108342.1 | NC_009105.1 | NC_020492.1 |
| AJPT00000000.1 | CM000559.1 | CM001679.1 | EF115542.1 | NC_009107.1 | NC_020493.1 |
| ALNU00000000.2 | CM000560.1 | CM001680.1 | EU325680.1 | NC_009108.1 | NC_020495.1 |
| ALNV00000000.2 | CM000561.1 | CM001681.1 | EU366230.1 | NC_009110.1 | NC_020496.1 |
| ALNW00000000.2 | CM000562.1 | CM001682.1 | EU747728.2 | NC_009111.1 | NC_020497.1 |
| ALXC00000000.1 | CM000563.1 | CM001683.1 | EU835853.1 | NC_009112.1 | NC_021160.1 |
| ALYE00000000.1 | CM000564.1 | CM001684.1 | FJ858267.1 | NC_009114.1 | NC_021161.1 |
| AM087200.3 | CM000565.1 | CM001685.1 | FJ859351.1 | NC_009115.1 | NC_021162.1 |
| AM292218.1 | CM000566.1 | CM001686.1 | FJ899745.1 | NC_009116.1 | NC_021163.1 |
| AM948965.1 | CM000567.1 | CM001687.1 | FJ906803.1 | NC_009118.1 | NC_021164.1 |
| AMGL00000000.1 | CM000568.1 | CM001688.1 | FM179380.1 | NC_009144.2 | NC_021165.1 |
| AMOP00000000.1 | CM000569.1 | CM001689.1 | FN597015.1 | NC_009145.2 | NC_021166.1 |
| AMYH00000000.2 | CM000570.1 | CM001690.1 | FN597017.1 | NC_009146.2 | NC_021167.1 |
| ANNZ00000000.1 | CM000571.1 | CM001691.1 | FN597018.1 | NC_009147.2 | NC_021621.1 |
| ANOA00000000.1 | CM000572.1 | CM001692.1 | FN597020.1 | NC_009148.2 | NC_021671.1 |
| ANPC00000000.1 | CM000573.1 | CM001693.1 | FN597022.1 | NC_009149.2 | NC_021672.1 |
| AOCR00000000.1 | CM000663.2 | CM001694.1 | FN597024.1 | NC_009150.2 | NC_021673.1 |
| AOCS00000000.1 | CM000664.2 | CM001695.1 | FN597025.1 | NC_009151.2 | NC_021674.1 |
| AOHF00000000.1 | CM000665.2 | CM001696.1 | FN597027.1 | NC_009152.2 | NC_021675.1 |
| AOIX00000000.1 | CM000666.2 | CM001697.1 | FN597028.1 | NC_009153.2 | NC_021676.1 |
| AP000423.1 | CM000667.2 | CM001698.1 | FN597030.1 | NC_009154.2 | NC_021677.1 |
| AP003321.1 | CM000668.2 | CM001699.1 | FN597032.1 | NC_009155.2 | NC_021678.1 |
| AP003322.1 | CM000669.2 | CM001701.1 | FN597034.1 | NC_009156.2 | NC_021679.1 |
| AP003323.1 | CM000670.2 | CM001702.1 | FN597036.1 | NC_009157.2 | NC_021680.1 |
| AP003428.1 | CM000671.2 | CM001703.1 | FN597038.1 | NC_009158.2 | NC_021681.1 |
| AP004421.1 | CM000672.2 | CM001704.1 | FN597039.1 | NC_009159.2 | NC_021682.1 |
| AP006444.1 | CM000673.2 | CM001705.1 | FN597040.1 | NC_009160.2 | NC_021683.1 |
| AP006728.1 | CM000674.2 | CM001706.1 | FN597042.1 | NC_009161.2 | NC_021684.1 |
| AP008207.2 | CM000675.2 | CM001707.1 | FN597044.1 | NC_009162.2 | NC_021685.1 |
| AP008208.2 | CM000676.2 | CM001708.1 | FN597046.1 | NC_009163.2 | NC_021686.1 |
| AP008209.2 | CM000677.2 | CM001709.1 | FN645450.1 | NC_009164.2 | NC_021687.1 |
| AP008210.2 | CM000678.2 | CM001710.1 | FN673705.1 | NC_009165.2 | NC_021688.1 |
| AP008211.2 | CM000679.2 | CM001711.1 | FP885845.1 | NC_009166.2 | NC_021689.1 |
| AP008212.2 | CM000680.2 | CM001712.1 | FR714868.1 | NC_009167.2 | NC_021690.1 |
| AP008213.2 | CM000681.2 | CM001713.1 | FR853080.1 | NC_009168.2 | NC_021691.1 |
| AP008214.2 | CM000682.2 | CM001714.1 | FR853081.1 | NC_009169.2 | NC_021692.1 |
| AP008215.2 | CM000683.2 | CM001715.1 | FR853082.1 | NC_009170.2 | NC_021693.1 |
| AP008216.2 | CM000684.2 | CM001716.1 | FR853083.1 | NC_009171.2 | NC_021694.1 |
| AP008217.2 | CM000685.2 | CM001717.1 | FR853084.1 | NC_009172.2 | NC_021695.1 |
| AP008218.2 | CM000686.2 | CM001718.1 | FR853085.1 | NC_009173.2 | NC_021696.1 |
| AP008982.1 | CM000695.1 | CM001719.1 | FR853086.1 | NC_009174.2 | NC_021697.1 |
| AP011076.1 | CM000696.1 | CM001720.1 | FR853087.1 | NC_009175.2 | NC_021698.1 |
| APMJ00000000.1 | CM000697.1 | CM001721.1 | FR853088.2 | NC_009259.1 | NC_021699.1 |
| AQIA00000000.1 | CM000698.1 | CM001722.1 | FR853089.1 | NC_009355.1 | NC_021700.1 |
| AQIB00000000.1 | CM000699.1 | CM001723.1 | FR853090.1 | NC_009356.1 | NC_021701.1 |
| ARYA00000000.1 | CM000700.1 | CM001724.1 | FR853091.1 | NC_009357.1 | NC_021702.1 |
| ASJS00000000.1 | CM000701.1 | CM001725.1 | FR853092.1 | NC_009358.1 | NC_021703.1 |
| ATDM00000000.1 | CM000702.1 | CM001726.1 | FR853093.1 | NC_009359.1 | NC_021957.1 |
| AUUT00000000.1 | CM000703.1 | CM001727.1 | FR853094.1 | NC_009360.1 | NC_022009.1 |
| AUXG00000000.1 | CM000704.1 | CM001728.1 | FR853095.1 | NC_009361.1 | NC_022010.1 |
| AVCL00000000.1 | CM000705.1 | CM001729.1 | FR853096.1 | NC_009362.1 | NC_022011.1 |
| AWHD00000000.1 | CM000706.1 | CM001730.1 | FR853097.1 | NC_009363.1 | NC_022012.1 |
| AY172335.1 | CM000707.1 | CM001731.1 | FR853098.2 | NC_009364.1 | NC_022013.1 |
| AY172581.1 | CM000708.1 | CM001732.1 | FR853099.1 | NC_009365.1 | NC_022014.1 |
| AY506529.1 | CM000709.1 | CM001733.1 | FR853100.1 | NC_009366.1 | NC_022015.1 |
| AY522329.1 | CM000710.1 | CM001734.1 | FR853101.1 | NC_009367.1 | NC_022016.1 |
| AY526085.1 | CM000711.1 | CM001735.1 | FR853102.1 | NC_009368.1 | NC_022017.1 |
| AY612638.1 | CM000712.1 | CM001736.1 | FR853103.1 | NC_009369.1 | NC_022018.1 |
| AY675564.1 | CM000713.1 | CM001737.1 | FR874244.1 | NC_009370.1 | NC_022019.1 |
| AYZS00000000.1 | CM000760.1 | CM001738.1 | FR874245.1 | NC_009371.1 | NC_022020.1 |
| AYZT00000000.1 | CM000761.1 | CM001739.1 | FR874246.1 | NC_009372.1 | NC_022021.1 |

TABLE 3-continued

GenBank accession numbers of published animal or plant chromosome sequences (including entry version number ".N"; GenBank database release 202, 15 Jun. 2014)

| | | | | | |
|---|---|---|---|---|---|
| AYZU00000000.1 | CM000762.1 | CM001740.1 | FR874247.1 | NC_009373.1 | NC_022022.1 |
| AYZW00000000.1 | CM000763.1 | CM001741.1 | FR874248.1 | NC_009374.1 | NC_022023.1 |
| AYZX00000000.1 | CM000764.1 | CM001742.1 | FR874249.1 | NC_009375.1 | NC_022024.1 |
| AYZY00000000.1 | CM000765.1 | CM001743.1 | FR874250.1 | NC_010195.2 | NC_022025.1 |
| AZHG00000000.1 | CM000766.1 | CM001744.1 | FR874251.1 | NC_010339.1 | NC_022026.1 |
| BA000009.3 | CM000767.1 | CM001745.1 | FR874252.1 | NC_010443.4 | NC_022027.1 |
| BA000014.8 | CM000768.1 | CM001746.1 | FR874253.1 | NC_010444.3 | NC_022028.1 |
| BA000015.5 | CM000769.1 | CM001747.1 | FR874254.1 | NC_010445.3 | NC_022029.1 |
| BA000029.3 | CM000780.3 | CM001748.1 | FR874255.1 | NC_010446.4 | NC_022030.1 |
| BA000046.3 | CM000781.3 | CM001749.1 | FR874256.1 | NC_010447.4 | NC_022031.1 |
| BA000047.1 | CM000782.3 | CM001750.1 | FR874257.1 | NC_010448.3 | NC_022032.1 |
| BAAE00000000.1 | CM000784.3 | CM001751.1 | FR874258.1 | NC_010449.4 | NC_022033.1 |
| BAAF00000000.4 | CM000785.3 | CM001752.1 | FR874259.1 | NC_010450.3 | NC_022034.1 |
| BAAG00000000.1 | CM000786.3 | CM001764.1 | FR874260.1 | NC_010451.3 | NC_022035.1 |
| BABO00000000.1 | CM000790.1 | CM001765.1 | FR874261.1 | NC_010452.3 | NC_022036.1 |
| BABP00000000.1 | CM000791.1 | CM001766.1 | FR874262.1 | NC_010453.4 | NC_022199.1 |
| BACJ00000000.1 | CM000792.1 | CM001767.1 | FR874263.1 | NC_010454.3 | NC_022200.1 |
| BL000001.2 | CM000793.1 | CM001768.1 | FR874264.1 | NC_010455.4 | NC_022201.1 |
| BX284601.5 | CM000794.1 | CM001769.1 | GK000001.2 | NC_010456.4 | NC_022202.1 |
| BX284602.5 | CM000795.1 | CM001770.1 | GK000002.2 | NC_010457.4 | NC_022203.1 |
| BX284603.4 | CM000796.1 | CM001771.1 | GK000003.2 | NC_010458.3 | NC_022204.1 |
| BX284604.4 | CM000797.1 | CM001778.1 | GK000004.2 | NC_010459.4 | NC_022205.1 |
| BX284605.5 | CM000798.1 | CM001779.1 | GK000005.2 | NC_010460.3 | NC_022206.1 |
| BX284606.5 | CM000799.1 | CM001780.1 | GK000006.2 | NC_010461.4 | NC_022207.1 |
| CAAA00000000.1 | CM000800.1 | CM001781.1 | GK000007.2 | NC_010462.2 | NC_022208.1 |
| CAAB00000000.2 | CM000801.1 | CM001782.1 | GK000008.2 | NC_010972.2 | NC_022209.1 |
| CAAP00000000.3 | CM000802.1 | CM001783.1 | GK000009.2 | NC_011032.1 | NC_022210.1 |
| CABD00000000.2 | CM000803.1 | CM001784.1 | GK000010.2 | NC_011033.1 | NC_022211.1 |
| CABG00000000.1 | CM000804.1 | CM001826.1 | GK000011.2 | NC_011088.1 | NC_022212.1 |
| CABZ00000000.1 | CM000805.1 | CM001827.1 | GK000012.2 | NC_011089.1 | NC_022213.1 |
| CACC00000000.1 | CM000806.1 | CM001828.1 | GK000013.2 | NC_011090.1 | NC_022214.1 |
| CAEC00000000.1 | CM000807.1 | CM001829.1 | GK000014.2 | NC_011091.1 | NC_022215.1 |
| CAIC00000000.1 | CM000808.1 | CM001830.1 | GK000015.2 | NC_011120.1 | NC_022216.1 |
| CAID00000000.1 | CM000809.1 | CM001831.1 | GK000016.1 | NC_011137.1 | NC_022217.1 |
| CAID01000001.1 | CM000810.1 | CM001832.1 | GK000017.2 | NC_011163.1 | NC_022218.1 |
| CAID01000002.1 | CM000811.1 | CM001833.1 | GK000018.2 | NC_011462.1 | NC_022219.1 |
| CAID01000003.1 | CM000812.4 | CM001879.1 | GK000019.2 | NC_011463.1 | NC_022220.1 |
| CAID01000004.1 | CM000813.4 | CM001880.1 | GK000020.2 | NC_011464.1 | NC_022272.1 |
| CAID01000005.1 | CM000814.4 | CM001881.1 | GK000021.2 | NC_011465.1 | NC_022273.1 |
| CAID01000006.1 | CM000815.4 | CM001882.1 | GK000022.2 | NC_011466.1 | NC_022274.1 |
| CAID01000007.1 | CM000816.4 | CM001883.1 | GK000023.2 | NC_011467.1 | NC_022275.1 |
| CAID01000008.1 | CM000817.4 | CM001884.1 | GK000024.2 | NC_011468.1 | NC_022276.1 |
| CAID01000009.1 | CM000818.4 | CM001885.1 | GK000025.2 | NC_011469.1 | NC_022277.1 |
| CAID01000010.1 | CM000819.4 | CM001886.1 | GK000026.2 | NC_011470.1 | NC_022278.1 |
| CAID01000011.1 | CM000820.4 | CM001887.1 | GK000027.2 | NC_011471.1 | NC_022279.1 |
| CAID01000012.1 | CM000821.4 | CM001888.1 | GK000028.2 | NC_011472.1 | NC_022280.1 |
| CAID01000013.1 | CM000822.4 | CM001919.1 | GK000029.2 | NC_011473.1 | NC_022281.1 |
| CAID01000014.1 | CM000823.4 | CM001920.1 | GK000030.2 | NC_011474.1 | NC_022282.1 |
| CAID01000015.1 | CM000824.4 | CM001921.1 | GK000031.3 | NC_011475.1 | NC_022283.1 |
| CAID01000016.1 | CM000825.4 | CM001922.1 | GK000032.3 | NC_011476.1 | NC_022284.1 |
| CAID01000017.1 | CM000826.4 | CM001923.1 | GK000033.3 | NC_011477.1 | NC_022285.1 |
| CAID01000018.1 | CM000827.4 | CM001924.1 | GK000034.3 | NC_011478.1 | NC_022286.1 |
| CAID01000019.1 | CM000828.4 | CM001925.1 | GQ861354.1 | NC_011479.1 | NC_022287.1 |
| CAID01000020.1 | CM000829.4 | CM001926.1 | GU147934.1 | NC_011480.1 | NC_022288.1 |
| CALO00000000.1 | CM000830.4 | CM001927.1 | GU238433.1 | NC_011481.1 | NC_022289.1 |
| CALP00000000.1 | CM000831.1 | CM001928.1 | GU295658.1 | NC_011482.1 | NC_022290.1 |
| CH003448.1 | CM000834.1 | CM001929.1 | HE601612.1 | NC_011483.1 | NC_022291.1 |
| CH003449.1 | CM000835.1 | CM001930.1 | HE601624.1 | NC_011484.1 | NC_022292.1 |
| CH003450.1 | CM000836.1 | CM001931.1 | HE601625.1 | NC_011485.1 | NC_022293.1 |
| CH003451.1 | CM000837.1 | CM001932.1 | HE601626.1 | NC_011486.1 | NC_022294.1 |
| CH003452.1 | CM000838.1 | CM001933.1 | HE601627.1 | NC_011487.1 | NC_022295.1 |
| CH003453.1 | CM000839.1 | CM001934.1 | HE601628.1 | NC_011488.1 | NC_022296.1 |
| CH003454.1 | CM000840.1 | CM001935.1 | HE601629.1 | NC_011489.1 | NC_022297.1 |
| CH003455.1 | CM000841.1 | CM001936.1 | HE601630.1 | NC_011490.1 | NC_022298.1 |
| CH003456.1 | CM000842.1 | CM001937.1 | HE601631.1 | NC_011491.1 | NC_022299.1 |
| CH003457.1 | CM000843.1 | CM001938.1 | HE602535.1 | NC_011492.1 | NC_022300.1 |
| CH003458.1 | CM000844.1 | CM001939.1 | HE602536.1 | NC_011493.1 | NC_022301.1 |
| CH003459.1 | CM000845.1 | CM001940.1 | HE602537.1 | NC_011494.1 | NC_022302.1 |
| CH003460.1 | CM000846.1 | CM001941.2 | HE602538.1 | NC_011495.1 | NC_022303.1 |
| CH003461.1 | CM000847.1 | CM001942.1 | HE602539.1 | NC_011496.1 | NC_022304.1 |
| CH003462.1 | CM000848.1 | CM001943.2 | HE602540.1 | NC_012007.3 | NC_022305.1 |
| CH003463.1 | CM000849.1 | CM001944.2 | HE602541.1 | NC_012008.3 | NC_022306.1 |
| CH003464.1 | CM000850.1 | CM001945.1 | HE602542.1 | NC_012009.3 | NC_022307.1 |
| CH003465.1 | CM000851.1 | CM001946.1 | HE602543.1 | NC_012010.3 | NC_022308.1 |
| CH003466.1 | CM000852.1 | CM001947.1 | HE602544.1 | NC_012011.3 | NC_022309.1 |
| CH003467.1 | CM000853.1 | CM001948.2 | HE602545.1 | NC_012012.3 | NC_022310.1 |

TABLE 3-continued

GenBank accession numbers of published animal or plant chromosome sequences (including entry version number ".N"; GenBank database release 202, 15 Jun. 2014)

| | | | | | |
|---|---|---|---|---|---|
| CH003468.1 | CM000856.1 | CM001949.2 | HE602546.1 | NC_012013.3 | NC_022311.1 |
| CH003469.1 | CM000857.1 | CM001950.2 | HE602547.1 | NC_012014.3 | NC_022312.1 |
| CH003470.1 | CM000858.1 | CM001951.2 | HE602548.1 | NC_012015.3 | NC_022313.1 |
| CH003471.1 | CM000859.1 | CM001952.2 | HE602549.1 | NC_012016.3 | NC_022314.1 |
| CH003496.1 | CM000860.1 | CM001953.2 | HE602550.1 | NC_012017.3 | NC_022315.1 |
| CH003497.1 | CM000861.1 | CM001954.1 | HE602551.1 | NC_012018.3 | NC_022316.1 |
| CH003498.1 | CM000862.1 | CM001955.2 | HE602552.1 | NC_012019.3 | NC_022317.1 |
| CH003499.1 | CM000863.1 | CM001956.2 | HE602553.1 | NC_012020.3 | NC_022318.1 |
| CH003500.1 | CM000864.1 | CM001957.1 | HE602554.1 | NC_012021.3 | NC_022319.1 |
| CH003501.1 | CM000865.1 | CM001958.2 | HE602555.1 | NC_012022.3 | NC_022320.1 |
| CH003502.1 | CM000866.1 | CM001959.2 | HE602556.1 | NC_012023.3 | NC_022321.1 |
| CH003503.1 | CM000867.1 | CM001960.2 | HE813975.1 | NC_012024.3 | NC_022322.1 |
| CH003504.1 | CM000868.1 | CM001961.2 | HE813976.1 | NC_012025.3 | NC_022668.1 |
| CH003505.1 | CM000869.1 | CM001962.2 | HE813977.1 | NC_012095.1 | NC_023046.1 |
| CH003506.1 | CM000870.1 | CM001963.2 | HE813978.1 | NC_012119.1 | NC_023047.1 |
| CH003507.1 | CM000871.1 | CM001964.1 | HE813979.1 | NC_012387.1 | NC_023048.1 |
| CH003508.1 | CM000872.1 | CM001965.2 | HE813980.1 | NC_012575.1 | NC_023049.1 |
| CH003509.1 | CM000873.1 | CM001966.2 | HE813981.1 | NC_012591.1 | NC_023050.1 |
| CH003510.1 | CM000874.1 | CM001967.1 | HE813982.1 | NC_012592.1 | NC_023051.1 |
| CH003511.1 | CM000875.1 | CM001968.1 | HE813983.1 | NC_012593.1 | NC_023052.1 |
| CH003512.1 | CM000876.1 | CM001969.1 | HE813984.1 | NC_012594.1 | NC_023053.1 |
| CH003513.1 | CM000877.1 | CM001970.2 | HE813985.1 | NC_012595.1 | NC_023054.1 |
| CH003514.1 | CM000878.1 | CM001971.1 | HQ244500.2 | NC_012596.1 | NC_023164.1 |
| CH003515.1 | CM000879.1 | CM001988.1 | HQ325744.1 | NC_012597.1 | NC_023165.1 |
| CH003516.1 | CM000880.1 | CM001989.1 | HT000001.1 | NC_012598.1 | NC_023168.1 |
| CH003517.1 | CM000881.1 | CM001990.1 | HT000002.1 | NC_012599.1 | NC_023170.1 |
| CH003518.1 | CM000882.1 | CM001991.1 | HT000003.1 | NC_012600.1 | NC_023171.1 |
| CH003519.1 | CM000883.1 | CM001992.1 | HT000004.1 | NC_012601.1 | NC_023179.1 |
| CM000001.3 | CM000884.1 | CM001993.1 | HT000005.1 | NC_012602.1 | NC_023180.1 |
| CM000002.3 | CM000885.1 | CM001994.1 | HT000006.1 | NC_012603.1 | NC_023181.1 |
| CM000003.3 | CM000886.1 | CM001995.1 | HT000007.1 | NC_012604.1 | NC_023182.1 |
| CM000004.3 | CM000887.1 | CM001996.1 | HT000008.1 | NC_012605.1 | NC_023183.1 |
| CM000005.3 | CM000888.1 | CM001997.1 | HT000009.1 | NC_012606.1 | NC_023184.1 |
| CM000006.3 | CM000889.1 | CM001998.1 | HT000010.1 | NC_012607.1 | NC_023185.1 |
| CM000007.3 | CM000890.1 | CM001999.1 | HT000011.1 | NC_012608.1 | NC_023186.1 |
| CM000008.3 | CM000891.1 | CM002000.1 | HT000012.1 | NC_012609.1 | NC_023187.1 |
| CM000009.3 | CM000892.1 | CM002001.1 | HT000013.1 | NC_012610.1 | NC_023188.1 |
| CM000010.3 | CM000893.1 | CM002002.1 | HT000014.1 | NC_012611.1 | NC_023189.1 |
| CM000011.3 | CM000894.1 | CM002003.1 | HT000188.1 | NC_012612.1 | NC_023190.1 |
| CM000012.3 | CM000895.1 | CM002004.1 | J01415.2 | NC_012613.1 | NC_023191.1 |
| CM000013.3 | CM000896.1 | CM002005.1 | JAQD00000000.1 | NC_012614.1 | NC_023192.1 |
| CM000014.3 | CM000897.1 | CM002006.1 | JAQJ00000000.1 | NC_012643.1 | NC_023193.1 |
| CM000015.3 | CM000898.1 | CM002007.1 | JF274081.1 | NC_012670.1 | NC_023194.1 |
| CM000016.3 | CM000899.1 | CM002008.1 | JF275060.1 | NC_012825.1 | NC_023195.1 |
| CM000017.3 | CM000900.1 | CM002009.1 | JF345175.1 | NC_012870.1 | NC_023196.1 |
| CM000018.3 | CM000901.1 | CM002010.1 | JF920285.1 | NC_012871.1 | NC_023197.1 |
| CM000019.3 | CM000902.1 | CM002011.1 | JF920286.1 | NC_012872.1 | NC_023198.1 |
| CM000020.3 | CM000903.1 | CM002012.1 | JFZQ00000000.1 | NC_012873.1 | NC_023199.1 |
| CM000021.3 | CM000904.1 | CM002013.1 | JJMF00000000.1 | NC_012874.1 | NC_023200.1 |
| CM000022.3 | CM000905.1 | CM002014.1 | JJNN00000000.1 | NC_012875.1 | NC_023201.1 |
| CM000023.3 | CM000906.1 | CM002015.1 | JJOQ00000000.1 | NC_012876.1 | NC_023202.1 |
| CM000024.3 | CM000907.1 | CM002016.1 | JMKK00000000.1 | NC_012877.1 | NC_023203.1 |
| CM000025.3 | CM000908.1 | CM002017.1 | JN005831.1 | NC_012878.1 | NC_023204.1 |
| CM000026.3 | CM000909.1 | CM002018.1 | JN005832.1 | NC_012879.1 | NC_023205.1 |
| CM000027.3 | CM000910.1 | CM002019.1 | JN637766.2 | NC_012920.1 | NC_023206.1 |
| CM000028.3 | CM000911.1 | CM002020.1 | JNHC00000000.1 | NC_013038.1 | NC_023207.1 |
| CM000029.3 | CM000915.2 | CM002081.1 | JQ396171.1 | NC_013039.1 | NC_023616.1 |
| CM000030.3 | CM000916.2 | CM002082.1 | JX463295.1 | NC_013040.1 | NC_023617.1 |
| CM000031.3 | CM000917.2 | CM002083.1 | JX946196.2 | NC_013041.1 | NC_023618.1 |
| CM000032.3 | CM000918.2 | CM002084.1 | KC757404.1 | NC_013042.1 | NC_023619.1 |
| CM000033.3 | CM000919.2 | CM002085.1 | KF293721.1 | NC_013043.1 | NC_023620.1 |
| CM000034.3 | CM000937.1 | CM002086.1 | KF428978.1 | NC_013044.1 | NC_023621.1 |
| CM000035.3 | CM000938.1 | CM002087.1 | KF765450.1 | NC_013045.1 | NC_023622.1 |
| CM000036.3 | CM000939.1 | CM002088.1 | KF874616.1 | NC_013046.1 | NC_023623.1 |
| CM000037.3 | CM000940.1 | CM002089.1 | KJ460033.1 | NC_013047.1 | NC_023624.1 |
| CM000038.3 | CM000941.1 | CM002090.1 | L06178.1 | NC_013048.1 | NC_023625.1 |
| CM000039.3 | CM000942.1 | CM002091.1 | L20934.1 | NC_013049.1 | NC_023642.1 |
| CM000054.5 | CM000943.1 | CM002092.1 | M11163.1 | NC_013050.1 | NC_023643.1 |
| CM000055.5 | CM000944.1 | CM002093.1 | NC_000001.11 | NC_013051.1 | NC_023644.1 |
| CM000056.5 | CM000945.1 | CM002094.1 | NC_000002.12 | NC_013052.1 | NC_023645.1 |
| CM000057.5 | CM000946.1 | CM002095.1 | NC_000003.12 | NC_013053.1 | NC_023646.1 |
| CM000058.5 | CM000947.1 | CM002096.1 | NC_000004.12 | NC_013054.1 | NC_023647.1 |
| CM000059.5 | CM000948.1 | CM002288.1 | NC_000005.10 | NC_013663.1 | NC_023648.1 |
| CM000060.5 | CM000949.1 | CM002289.1 | NC_000006.12 | NC_013669.1 | NC_023649.1 |
| CM000061.5 | CM000962.1 | CM002290.1 | NC_000007.14 | NC_013670.1 | NC_023650.1 |
| CM000062.5 | CM000963.1 | CM002291.1 | NC_000008.11 | NC_013671.1 | NC_023651.1 |

TABLE 3-continued

GenBank accession numbers of published animal or
plant chromosome sequences (including entry version number ".N";
GenBank database release 202, 15 Jun. 2014)

| | | | | | |
|---|---|---|---|---|---|
| CM000063.5 | CM000964.1 | CM002292.1 | NC_000009.12 | NC_013672.1 | NC_023652.1 |
| CM000064.5 | CM000965.1 | CM002293.1 | NC_000010.11 | NC_013673.1 | NC_023653.1 |
| CM000065.5 | CM000966.1 | CM002294.1 | NC_000011.10 | NC_013674.1 | NC_023654.1 |
| CM000066.5 | CM000967.1 | CM002295.1 | NC_000012.12 | NC_013675.1 | NC_023655.1 |
| CM000067.5 | CM000968.1 | CM002296.1 | NC_000013.11 | NC_013676.1 | NC_023656.1 |
| CM000068.5 | CM000969.1 | CM002297.1 | NC_000014.9 | NC_013677.1 | NC_023657.1 |
| CM000069.5 | CM000970.1 | CM002298.1 | NC_000015.10 | NC_013678.1 | NC_023658.1 |
| CM000070.3 | CM000971.1 | CM002312.1 | NC_000016.10 | NC_013679.1 | NC_023659.1 |
| CM000071.3 | CM000972.1 | CM002313.1 | NC_000017.11 | NC_013680.1 | NC_023660.1 |
| CM000072.4 | CM000973.1 | CM002314.1 | NC_000018.10 | NC_013681.1 | NC_023661.1 |
| CM000073.4 | CM000974.1 | CM002315.1 | NC_000019.10 | NC_013682.1 | NC_023662.1 |
| CM000074.4 | CM000975.1 | CM002316.1 | NC_000020.11 | NC_013683.1 | NC_023663.1 |
| CM000075.4 | CM000976.1 | CM002317.1 | NC_000021.9 | NC_013684.1 | NC_023664.1 |
| CM000076.4 | CM000977.1 | CM002318.1 | NC_000022.11 | NC_013685.1 | NC_023665.1 |
| CM000077.4 | CM000978.1 | CM002319.1 | NC_000023.11 | NC_013686.1 | NC_023666.1 |
| CM000078.4 | CM000979.1 | CM002320.1 | NC_000024.10 | NC_013687.1 | NC_023667.1 |
| CM000079.4 | CM000980.1 | CM002321.1 | NC_000067.6 | NC_013688.1 | NC_023668.1 |
| CM000080.4 | CM000981.1 | CM002322.1 | NC_000068.7 | NC_013689.1 | NC_023669.1 |
| CM000081.4 | CM000982.1 | CM002323.1 | NC_000069.6 | NC_013690.1 | NC_023670.1 |
| CM000082.4 | CM000983.1 | CM002324.1 | NC_000070.6 | NC_013816.1 | NC_023671.1 |
| CM000083.4 | CM000984.1 | CM002325.1 | NC_000071.6 | NC_013896.1 | NC_023672.1 |
| CM000084.4 | CM000985.1 | CM002326.1 | NC_000072.6 | NC_013897.1 | NC_023749.1 |
| CM000085.4 | CM000986.1 | CM002327.1 | NC_000073.6 | NC_013898.1 | NC_023750.1 |
| CM000086.4 | CM000987.1 | CM002328.1 | NC_000074.6 | NC_013899.1 | NC_023751.1 |
| CM000087.4 | CM000988.1 | CM002329.1 | NC_000075.6 | NC_013900.1 | NC_023752.1 |
| CM000088.4 | CM000989.1 | CM002349.1 | NC_000076.6 | NC_013901.1 | NC_023753.1 |
| CM000089.4 | CM000990.1 | CM002350.1 | NC_000077.6 | NC_013902.1 | NC_023754.1 |
| CM000090.4 | CM000991.1 | CM002351.1 | NC_000078.6 | NC_013903.1 | NC_023755.1 |
| CM000091.4 | CM000992.1 | CM002352.1 | NC_000079.6 | NC_013904.1 | NC_023756.1 |
| CM000092.4 | CM000993.1 | CM002353.1 | NC_000080.6 | NC_013905.1 | NC_023757.1 |
| CM000093.3 | CM000994.2 | CM002354.1 | NC_000081.6 | NC_013906.1 | NC_023758.1 |
| CM000094.3 | CM000995.2 | CM002355.1 | NC_000082.6 | NC_013907.1 | NC_023759.1 |
| CM000095.3 | CM000996.2 | CM002356.1 | NC_000083.6 | NC_013908.1 | NC_023798.1 |
| CM000096.3 | CM000997.2 | CM002357.1 | NC_000084.6 | NC_013909.1 | NC_023890.1 |
| CM000097.3 | CM000998.2 | CM002358.1 | NC_000085.6 | NC_013910.1 | NC_024126.1 |
| CM000098.3 | CM000999.2 | CM002359.1 | NC_000086.7 | NC_013911.1 | NC_024127.1 |
| CM000099.3 | CM001000.2 | CM002360.1 | NC_000087.7 | NC_013912.1 | NC_024128.1 |
| CM000100.3 | CM001001.2 | CM002361.1 | NC_000845.1 | NC_013913.1 | NC_024129.1 |
| CM000101.3 | CM001002.2 | CM002362.1 | NC_000891.1 | NC_013914.1 | NC_024130.1 |
| CM000102.3 | CM001003.2 | CM002363.1 | NC_000932.1 | NC_013915.1 | NC_024131.1 |
| CM000103.3 | CM001004.2 | CM002364.1 | NC_001284.2 | NC_013916.1 | NC_024132.1 |
| CM000104.3 | CM001005.2 | CM002373.1 | NC_001320.1 | NC_013917.1 | NC_024133.1 |
| CM000105.3 | CM001006.2 | CM002374.1 | NC_001322.1 | NC_013918.1 | NC_024218.1 |
| CM000106.3 | CM001007.2 | CM002375.1 | NC_001323.1 | NC_013919.1 | NC_024219.1 |
| CM000107.3 | CM001008.2 | CM002376.1 | NC_001328.1 | NC_013993.1 | NC_024220.1 |
| CM000108.3 | CM001009.2 | CM002377.1 | NC_001400.1 | NC_014426.1 | NC_024221.1 |
| CM000109.3 | CM001010.2 | CM002378.1 | NC_001566.1 | NC_014427.1 | NC_024222.1 |
| CM000110.3 | CM001011.2 | CM002379.1 | NC_001640.1 | NC_014428.1 | NC_024223.1 |
| CM000111.3 | CM001012.2 | CM002380.1 | NC_001643.1 | NC_014429.1 | NC_024224.1 |
| CM000112.3 | CM001013.2 | CM002381.1 | NC_001645.1 | NC_014430.1 | NC_024225.1 |
| CM000113.3 | CM001014.2 | CM002382.1 | NC_001665.2 | NC_014431.1 | NC_024226.1 |
| CM000114.3 | CM001026.1 | CM002383.1 | NC_001666.2 | NC_014432.1 | NC_024227.1 |
| CM000115.3 | CM001027.1 | CM002384.1 | NC_001700.1 | NC_014433.1 | NC_024228.1 |
| CM000116.3 | CM001028.1 | CM002385.1 | NC_001709.1 | NC_014434.1 | NC_024229.1 |
| CM000117.3 | CM001029.1 | CM002386.1 | NC_001751.1 | NC_014435.1 | NC_024230.1 |
| CM000118.3 | CM001030.1 | CM002387.1 | NC_001776.1 | NC_014436.1 | NC_024231.1 |
| CM000119.3 | CM001031.1 | CM002388.1 | NC_001941.1 | NC_014437.1 | NC_024232.1 |
| CM000120.2 | CM001032.1 | CM002389.1 | NC_002008.4 | NC_014438.1 | NC_024233.1 |
| CM000121.3 | CM001033.1 | CM002390.1 | NC_002083.1 | NC_014439.1 | NC_024234.1 |
| CM000122.3 | CM001034.1 | CM002391.1 | NC_002084.1 | NC_014440.1 | NC_024235.1 |
| CM000123.3 | CM001035.1 | CM002392.1 | NC_002333.2 | NC_014441.1 | NC_024238.1 |
| CM000124.3 | CM001036.1 | CM002393.1 | NC_002511.2 | NC_014442.1 | NT_033777.2 |
| CM000126.1 | CM001037.1 | CM002394.1 | NC_002545.1 | NC_014443.1 | NT_033778.3 |
| CM000127.1 | CM001038.1 | CM002476.1 | NC_002762.1 | NC_014444.1 | NT_033779.4 |
| CM000128.1 | CM001039.1 | CM002477.1 | NC_003070.9 | NC_014445.1 | NT_037436.3 |
| CM000129.1 | CM001040.1 | CM002478.1 | NC_003071.7 | NC_014676.2 | NT_078265.2 |
| CM000130.1 | CM001041.1 | CM002479.1 | NC_003074.8 | NC_014692.1 | NT_078266.2 |
| CM000131.1 | CM001042.1 | CM002480.1 | NC_003075.7 | NC_014776.1 | NT_078267.5 |
| CM000132.1 | CM001053.1 | CM002481.1 | NC_003076.8 | NC_014777.1 | NT_078268.4 |
| CM000133.1 | CM001054.1 | CM002482.1 | NC_003081.2 | NC_014778.1 | NT_167061.1 |
| CM000134.1 | CM001055.1 | CM002483.1 | NC_003119.6 | NC_014779.1 | NT_167062.1 |
| CM000135.2 | CM001056.1 | CM002484.1 | NC_003279.8 | NC_014780.1 | NT_167063.1 |
| CM000136.1 | CM001057.1 | CM002485.1 | NC_003280.10 | NC_014781.1 | NT_167064.1 |
| CM000137.1 | CM001058.1 | CM002486.1 | NC_003281.10 | NC_014782.1 | NT_167065.1 |
| CM000138.1 | CM001059.1 | CM002487.1 | NC_003282.8 | NC_014783.1 | NT_167066.1 |
| CM000139.1 | CM001061.2 | CM002488.1 | NC_003283.11 | NC_014784.1 | NT_167067.1 |

TABLE 3-continued

GenBank accession numbers of published animal or
plant chromosome sequences (including entry version number ".N";
GenBank database release 202, 15 Jun. 2014)

| | | | | | |
|---|---|---|---|---|---|
| CM000140.1 | CM001064.1 | CM002489.1 | NC_003284.9 | NC_014785.1 | NT_167068.1 |
| CM000141.1 | CM001065.1 | CM002490.1 | NC_004299.1 | NC_014786.1 | NW_001471666.1 |
| CM000142.1 | CM001066.1 | CM002491.1 | NC_004353.3 | NC_014787.1 | NW_003722731.1 |
| CM000143.1 | CM001067.1 | CM002492.1 | NC_004354.3 | NC_014788.1 | NW_003722735.1 |
| CM000144.1 | CM001068.1 | CM002493.1 | NC_004387.1 | NC_015011.1 | NW_003722737.1 |
| CM000145.1 | CM001069.1 | CM002494.1 | NC_004447.2 | NC_015012.1 | NW_003722738.1 |
| CM000146.1 | CM001070.1 | CM002495.1 | NC_004744.1 | NC_015013.1 | NW_003722739.1 |
| CM000147.1 | CM001071.1 | CM002496.1 | NC_004818.2 | NC_015014.1 | NW_003722740.1 |
| CM000148.1 | CM001072.1 | CM002497.1 | NC_004946.1 | NC_015015.1 | NW_003722741.1 |
| CM000149.1 | CM001073.1 | CM002498.1 | NC_005044.2 | NC_015016.1 | NW_003722744.1 |
| CM000157.2 | CM001074.1 | CM002499.1 | NC_005089.1 | NC_015017.1 | NW_003722745.1 |
| CM000158.2 | CM001075.1 | CM002500.1 | NC_005100.3 | NC_015018.1 | NW_003722746.1 |
| CM000159.2 | CM001155.2 | CM002501.1 | NC_005101.3 | NC_015019.1 | NW_003722747.1 |
| CM000160.2 | CM001169.1 | CM002502.1 | NC_005102.3 | NC_015020.1 | NW_003722749.1 |
| CM000161.2 | CM001170.1 | CM002503.1 | NC_005103.3 | NC_015021.1 | NW_003722750.1 |
| CM000162.2 | CM001171.1 | CM002504.1 | NC_005104.3 | NC_015022.1 | NW_004080165.1 |
| CM000163.1 | CM001172.1 | CM002505.1 | NC_005105.3 | NC_015023.1 | NW_004080166.1 |
| CM000164.1 | CM001173.1 | CM002506.1 | NC_005106.3 | NC_015024.1 | NW_004080169.1 |
| CM000165.1 | CM001174.1 | CM002507.1 | NC_005107.3 | NC_015025.1 | NW_004080172.1 |
| CM000166.1 | CM001175.1 | CM002508.1 | NC_005108.3 | NC_015026.1 | NW_004080173.1 |
| CM000167.1 | CM001176.1 | CM002509.1 | NC_005109.3 | NC_015027.1 | NW_004080175.1 |
| CM000168.1 | CM001177.1 | CM002510.1 | NC_005110.3 | NC_015028.1 | NW_004080179.1 |
| CM000177.5 | CM001178.1 | CM002511.1 | NC_005111.3 | NC_015029.1 | NW_004080182.1 |
| CM000178.5 | CM001179.1 | CM002512.1 | NC_005112.3 | NC_015030.1 | NW_004080184.1 |
| CM000179.5 | CM001180.1 | CM002513.1 | NC_005113.3 | NC_015031.1 | NW_004080185.1 |
| CM000180.5 | CM001181.1 | CM002514.1 | NC_005114.3 | NC_015032.1 | NW_004080188.1 |
| CM000181.5 | CM001182.1 | CM002515.1 | NC_005115.3 | NC_015033.1 | NW_004190323.1 |
| CM000182.5 | CM001183.1 | CM002516.1 | NC_005116.3 | NC_015034.1 | NW_004190325.1 |
| CM000183.5 | CM001184.1 | CM002517.1 | NC_005117.3 | NC_015035.1 | NW_004190326.1 |
| CM000184.5 | CM001185.1 | CM002518.1 | NC_005118.3 | NC_015036.1 | NW_004190327.1 |
| CM000185.5 | CM001186.1 | CM002519.1 | NC_005119.3 | NC_015037.1 | NW_004190329.1 |
| CM000186.5 | CM001187.1 | CM002520.1 | NC_005120.3 | NC_015038.1 | NW_004190330.1 |
| CM000187.5 | CM001188.1 | CM002521.1 | NC_005781.1 | NC_015039.1 | NW_004190331.1 |
| CM000188.5 | CM001189.1 | CM002522.1 | NC_005943.1 | NC_015040.1 | NW_004190332.1 |
| CM000189.5 | CM001190.1 | CM002523.1 | NC_005973.1 | NC_015041.1 | NW_004190336.1 |
| CM000190.5 | CM001191.1 | CM002524.1 | NC_006088.3 | NC_015042.1 | NW_004440457.1 |
| CM000191.5 | CM001192.1 | CM002525.1 | NC_006089.3 | NC_015099.1 | NW_004440460.1 |
| CM000192.4 | CM001193.1 | CM002526.1 | NC_006090.3 | NC_015139.1 | NW_006267373.1 |
| CM000193.5 | CM001217.1 | CM002527.1 | NC_006091.3 | NC_015206.1 | NW_006267376.1 |
| CM000194.5 | CM001218.1 | CM002528.1 | NC_006092.3 | NC_015438.1 | NW_006267377.1 |
| CM000195.5 | CM001219.1 | CM002529.1 | NC_006093.3 | NC_015439.1 | NW_006267379.1 |
| CM000196.5 | CM001220.1 | CM002530.1 | NC_006094.3 | NC_015440.1 | NW_006267382.1 |
| CM000197.5 | CM001221.1 | CM002531.1 | NC_006095.3 | NC_015441.1 | NW_006267383.1 |
| CM000198.5 | CM001222.1 | CM002532.1 | NC_006096.3 | NC_015442.1 | NW_006267384.1 |
| CM000199.6 | CM001223.1 | CM002533.1 | NC_006097.3 | NC_015443.1 | NZ_AAAB00000000.1 |
| CM000200.5 | CM001224.1 | CM002534.1 | NC_006098.3 | NC_015444.1 | NZ_AABU00000000.1 |
| CM000201.5 | CM001241.2 | CM002535.1 | NC_006099.3 | NC_015445.1 | NZ_AADE00000000.1 |
| CM000202.5 | CM001242.1 | CM002639.1 | NC_006100.3 | NC_015446.1 | NZ_AAEU00000000.2 |
| CM000203.5 | CM001243.2 | CM002640.2 | NC_006101.3 | NC_015447.1 | NZ_AAGH00000000.1 |
| CM000204.5 | CM001244.2 | CM002641.2 | NC_006102.3 | NC_015448.1 | NZ_AANI00000000.1 |
| CM000205.5 | CM001245.2 | CM002642.2 | NC_006103.3 | NC_015449.1 | NZ_ABXC00000000.1 |
| CM000206.4 | CM001246.2 | CM002643.2 | NC_006104.3 | NC_015762.1 | U20753.1 |
| CM000231.2 | CM001247.2 | CM002644.1 | NC_006105.3 | NC_015763.1 | U37541.1 |
| CM000232.2 | CM001248.2 | CM002645.1 | NC_006106.3 | NC_015764.1 | U96639.2 |
| CM000233.2 | CM001249.2 | CM002646.2 | NC_006107.3 | NC_015765.1 | X03240.1 |
| CM000234.2 | CM001250.2 | CM002647.1 | NC_006108.3 | NC_015766.1 | X15901.1 |
| CM000235.2 | CM001251.2 | CM002648.1 | NC_006109.3 | NC_015767.1 | X52392.1 |
| CM000236.2 | CM001252.2 | CM002649.1 | NC_006110.3 | NC_015768.1 | X54252.1 |
| CM000237.2 | CM001253.1 | CM002650.1 | NC_006111.3 | NC_015769.1 | X79547.1 |
| CM000238.2 | CM001254.1 | CM002655.1 | NC_006112.2 | NC_015770.1 | X83427.1 |
| CM000239.2 | CM001255.1 | CM002656.1 | NC_006113.3 | NC_015771.1 | X86563.2 |
| CM000240.1 | CM001256.1 | CM002657.1 | NC_006114.3 | NC_015772.1 | X93347.1 |
| CM000241.2 | CM001257.1 | CM002658.1 | NC_006115.3 | NC_015773.1 | X97707.1 |
| CM000242.1 | CM001258.1 | CM002659.1 | NC_006119.2 | NC_015774.1 | Y08501.2 |
| CM000243.2 | CM001259.1 | CM002660.1 | NC_006126.3 | NC_015775.1 | |
| CM000245.1 | CM001260.1 | CM002661.1 | NC_006127.3 | NC_015776.1 | |
| CM000246.2 | CM001261.1 | CM002662.1 | NC_006299.1 | NC_015777.1 | |

TABLE 4

GenBank accession numbers of published prokaryote chromosome and plasmid sequences, and virus sequences (including entry version number ".N"; GenBank database release 202, 15 Jun. 2014)

| | | | | | |
|---|---|---|---|---|---|
| | NC_021002.1 | NC_017330.1 | NC_017447.1 | NC_017982 | NC_023865 |
| NC_009641.1 | NC_014921.1 | NC_017329.1 | NC_017444.1 | NC_003982 | NC_019542 |
| NC_022593.1 | NC_008781.1 | NC_017320.1 | NZ_CM002178.1 | NC_003983 | NC_019522 |
| NC_002737.1 | NC_013716.1 | NC_017319.1 | NZ_CM002179.1 | NC_023882 | NC_020201 |
| NC_007297.1 | NC_008025.1 | NC_004943.1 | NC_009425.1 | NC_003748 | NC_012118 |
| NC_022658.1 | NC_009253.1 | NC_004253.1 | NC_021492.1 | NC_017862 | NC_016161 |
| NC_022659.1 | NC_013949.1 | NC_004252.1 | NC_015063.1 | NC_020085 | NC_001837 |
| NZ_CM001848.1 | NC_010337.2 | NC_015066.1 | NC_015062.1 | NC_020084 | NC_020484 |
| NC_017196.1 | NC_016011.1 | NC_015053.1 | NC_003270.1 | NC_020501 | NC_020481 |
| NZ_CM001793.1 | NC_013891.1 | NC_017220.1 | NC_003267.1 | NC_012664 | NC_020482 |
| NC_015844.1 | NZ_CM001051.1 | NC_017222.1 | NC_003240.1 | NC_015553 | NC_020483 |
| NC_021894.1 | NC_008555.1 | NC_006298.1 | NC_003276.1 | NC_010352 | NC_005985 |
| NC_008512.1 | NC_008228.1 | NZ_CM001987.1 | NC_003241.1 | NC_009549 | NC_005286 |
| NC_018414.1 | NC_015931.1 | NC_005128.1 | NC_003273.1 | NC_009559 | NC_007017 |
| NC_018415.1 | NC_009767.1 | NZ_CM001801.1 | NC_019685.1 | NC_006951 | NC_005285 |
| NC_018416.1 | NC_016640.1 | NC_012923.1 | NC_019677.1 | NC_011765 | NC_013262 |
| NC_018417.1 | NZ_CM001632.1 | NC_008712.1 | NC_008539.1 | NC_009014 | NC_003649 |
| NC_018418.1 | NC_009437.1 | NC_008713.1 | NC_008538.1 | NC_019932 | NC_003650 |
| NC_009937.1 | NC_009138.1 | NC_009084.1 | NC_008537.1 | NC_023557 | NC_003651 |
| NC_020419.1 | NC_012779.2 | NC_009083.1 | NC_009453.1 | NC_023579 | NC_007915 |
| NC_022115.1 | NC_014752.1 | NC_010605.1 | NC_018532.1 | NC_022744 | NC_022897 |
| NC_012730.1 | NC_007964.1 | NC_010606.1 | NC_016634.1 | NC_016767 | NC_007218 |
| NC_012960.1 | NC_007406.1 | NC_011585.1 | NC_008320.1 | NC_023610 | NC_011545 |
| NZ_CM001047.1 | NC_007716.1 | NC_010403.1 | NC_008573.1 | NC_019926 | NC_014977 |
| NC_015155.1 | NC_007722.1 | NC_010402.1 | NC_009475.1 | NC_015292 | NC_014978 |
| NC_015153.1 | NC_009615.1 | NC_010404.1 | NC_005229.1 | NC_011811 | NC_007539 |
| NC_014497.1 | NC_017218.1 | NC_010401.1 | NC_005231.1 | NC_019929 | NC_007540 |
| NC_017293.1 | NC_020517.1 | NC_020525.1 | NC_005230.1 | NC_015295 | NC_007541 |
| NC_015736.1 | NC_014328.1 | NC_017848.1 | NC_005232.1 | NC_019504 | NC_007542 |
| NC_018219.1 | NC_018721.1 | NC_020524.1 | NC_020296.1 | NC_019510 | NC_007221 |
| NC_018149.1 | NC_014230.1 | NC_017164.1 | NC_020290.1 | NC_019514 | NC_007223 |
| NC_016112.1 | NC_010184.1 | NC_017163.1 | NC_020289.1 | NC_001977 | NC_007222 |
| NC_017025.1 | NC_008268.1 | NC_017165.1 | NC_020298.1 | NC_004913 | NC_005977 |
| NC_000868.1 | NC_007292.1 | NC_017166.1 | NC_020297.1 | NC_022323 | NC_005976 |
| NZ_CM001973.1 | NC_007109.1 | NC_017172.1 | NC_020288.1 | NC_019725 | NC_007147 |
| NZ_CM001975.1 | NC_009092.1 | NC_021728.1 | NC_020287.1 | NC_016570 | NC_004067 |
| NZ_CM001979.1 | NC_008048.1 | NC_021727.1 | NC_007949.1 | NC_013594 | NC_004096 |
| NZ_CM001983.1 | NC_007908.1 | NC_021734.1 | NC_007950.1 | NC_016158 | NC_004101 |
| NZ_CM001984.1 | NC_007614.1 | NC_021730.1 | NC_020548.1 | NC_016160 | NC_001369 |
| NC_018581.1 | NC_008344.1 | NC_021731.1 | NC_008147.1 | NC_018859 | NC_001359 |
| NC_020505.1 | NC_009776.1 | NC_021732.1 | NC_008703.1 | NC_023593 | NC_004192 |
| NC_021555.1 | NC_007969.1 | NC_019985.2 | NC_008704.1 | NC_018854 | NC_016984 |
| NC_022575.1 | NC_007514.1 | NC_023031.1 | NC_014841.1 | NC_021344 | NC_010619 |
| NC_021919.1 | NC_007181.1 | NC_010398.1 | NC_014840.1 | NC_008720 | NC_010618 |
| NC_021024.1 | NC_020247.1 | NC_010395.1 | NC_014839.1 | NC_018846 | NC_000882 |
| NC_022588.1 | NC_020246.1 | NC_010396.1 | NC_014842.1 | NC_019452 | NC_010235 |
| NZ_CM001773.1 | NC_023069.1 | NZ_AEOY01000096.1 | NC_014838.1 | NC_019445 | NC_003630 |
| NC_023002.1 | NC_009009.1 | NZ_AEOY01000095.1 | NC_019728.1 | NC_019442 | NC_001517 |
| NC_023030.1 | NC_007681.1 | NZ_AEOZ01000236.1 | NC_019752.1 | NC_017969 | NC_003670 |
| NC_023030.1 | NC_009376.1 | NZ_AEPA01000395.1 | NC_019727.1 | NC_020079 | NC_003669 |
| NC_023062.1 | NC_007350.1 | NZ_AEPA01000396.1 | NC_017193.1 | NC_023743 | NC_008393 |
| NC_022906.1 | NC_009828.1 | NZ_AFDA02000006.1 | NC_022111.1 | NC_019520 | NC_015050 |
| NC_022905.1 | NC_010525.1 | NZ_AFDA02000007.1 | NC_015579.1 | NC_007804 | NC_011918 |
| NC_022907.1 | NC_014623.1 | NZ_AFDA02000008.1 | NC_015582.1 | NC_011041 | NC_020236 |
| NC_022908.1 | NC_015634.1 | NZ_AFDA02000009.1 | NC_015583.1 | NC_015933 | NC_008284 |
| NC_002163.1 | NC_016023.1 | NZ_AFDA02000010.1 | NC_019690.1 | NC_019505 | NC_008283 |
| NC_003912.7 | NC_012796.1 | NZ_AFDA02000011.1 | NC_019428.1 | NC_012749 | NC_014327 |
| NC_008787.1 | NC_010397.1 | NZ_AFDB02000003.1 | NC_019429.1 | NC_016518 | NC_005347 |
| NC_009707.1 | NC_018150.1 | NZ_AFDB02000004.1 | NC_019440.1 | NC_016517 | NC_020803 |
| NC_009839.1 | NC_021282.1 | NZ_AFDB02000005.1 | NC_019747.1 | NC_004068 | NC_003113 |
| NC_017279.1 | NC_013457.1 | NZ_AFCZ02000004.1 | NC_020051.1 | NC_010738 | NC_000936 |
| NC_017280.1 | NC_013456.1 | NZ_AFCZ02000003.1 | NC_019759.1 | NC_004515 | NC_019024 |
| NZ_AASL01000001.1 | NC_016613.1 | NZ_AFDO01000021.1 | NC_019476.1 | NC_003556 | NC_016648 |
| NC_014802.1 | NC_016614.1 | NZ_AFDK01000004.1 | NC_019760.1 | NC_005319 | NC_018272 |
| NC_017281.1 | NC_014323.1 | NZ_ALAL01000013.1 | NC_019742.1 | NC_008305 | NC_018271 |
| NC_018709.2 | NC_014012.1 | NZ_AFDL01000006.1 | NC_019739.1 | NC_008304 | NC_017989 |
| NC_018521.1 | NC_014319.1 | NZ_AFDL01000007.1 | NC_019761.1 | NC_014630 | NC_017988 |
| NC_021834.1 | NC_009720.1 | NZ_AFDL01000008.1 | NC_019743.1 | NC_012553 | NC_023983 |
| NC_022362.1 | NC_010530.1 | NZ_AFDL01000005.1 | NC_019762.1 | NC_012554 | NC_018381 |
| NC_022529.1 | NC_010528.1 | NZ_AFDM01000010.1 | NC_019740.1 | NC_012639 | NC_004573 |
| NC_022351.1 | NC_008340.1 | NZ_ALII01000018.1 | NC_019741.1 | NC_003412 | NC_007749 |
| NC_022353.1 | NC_008726.1 | NZ_ALII01000020.1 | NC_010374.1 | NC_009527 | NC_007754 |
| NC_022352.1 | NC_007426.1 | NZ_ALII01000019.1 | NC_010373.1 | NC_009528 | NC_007757 |
| NZ_CM000854.1 | NC_008553.1 | NZ_AFDN01000003.1 | NC_003065.3 | NC_002615 | NC_007748 |
| NZ_CM000855.1 | NC_008789.1 | NC_006297.1 | NC_003064.2 | NC_017940 | NC_007750 |
| NC_007492.2 | NC_009483.1 | NC_006873.1 | NC_008242.1 | NC_013108 | NC_007751 |

TABLE 4-continued

GenBank accession numbers of published prokaryote chromosome and plasmid sequences, and virus sequences (including entry version number ".N"; GenBank database release 202, 15 Jun. 2014)

| | | | | | |
|---|---|---|---|---|---|
| NC_012660.1 | NC_009484.1 | NC_007607.1 | NC_008244.1 | NC_013105 | NC_007755 |
| NC_016830.1 | NC_008009.1 | NC_009344.1 | NC_008243.1 | NC_013106 | NC_007752 |
| NC_017911.1 | NC_007645.1 | NC_006365.1 | NC_007801.1 | NC_013107 | NC_007756 |
| NZ_CM001025.1 | NC_014483.1 | NC_006366.1 | NC_008697.1 | NC_003702 | NC_007753 |
| NZ_CM001513.1 | NC_014622.1 | NC_006361.1 | NC_008765.1 | NC_003707 | NC_006383 |
| NZ_CM001512.1 | NC_017542.1 | NC_018141.1 | NC_008766.1 | NC_003697 | NC_003678 |
| NZ_CM001558.1 | NC_023037.1 | NC_020522.1 | NC_009517.1 | NC_003706 | NC_018713 |
| NZ_CM001561.1 | NC_010471.1 | NC_009346.1 | NC_009516.1 | NC_003698 | NC_001839 |
| NZ_CM001560.1 | NC_009922.1 | NC_009345.1 | NC_021662.1 | NC_003699 | NC_021312 |
| NC_003902.1 | NC_009441.1 | NC_007385.1 | NC_021668.1 | NC_003700 | NC_021333 |
| NC_007086.1 | NC_015856.1 | NC_016834.1 | NC_021669.1 | NC_003701 | NC_010392 |
| NC_010688.1 | NC_013861.1 | NC_016824.1 | NC_010335.1 | NC_003703 | NC_010393 |
| NC_017271.1 | NC_008578.1 | NC_016823.1 | NC_010333.1 | NC_003704 | NC_006938 |
| NC_003197.1 | NC_007677.1 | NC_016833.1 | NC_010542.1 | NC_003705 | NC_010295 |
| NC_003198.1 | NC_014032.1 | NC_008500.1 | NC_010543.1 | NC_003696 | NC_023678 |
| NC_004631.1 | NC_010001.1 | NC_008501.1 | NC_010539.1 | NC_023881 | NC_013999 |
| NC_006511.1 | NC_008709.1 | NC_007595.1 | NC_010541.1 | NC_023880 | NC_009991 |
| NC_016856.1 | NC_007759.1 | NC_009035.1 | NC_011721.1 | NC_013097 | NC_009383 |
| NC_006905.1 | NC_015677.1 | NC_009037.1 | NC_011723.1 | NC_013096 | NC_018074 |
| NC_011294.1 | NC_009636.1 | NC_009036.1 | NC_011727.1 | NC_013095 | NC_018075 |
| NC_011274.1 | NC_008698.1 | NC_009038.1 | NC_011732.1 | NC_013098 | NC_018076 |
| NC_011080.1 | NC_009972.1 | NC_009661.1 | NC_011737.1 | NC_013094 | NC_009551 |
| NC_012125.1 | NC_011899.1 | NC_011668.1 | NC_011730.1 | NC_013099 | NC_008367 |
| NC_010067.1 | NC_010482.1 | NC_011664.1 | NC_011738.1 | NC_013100 | NC_004062 |
| NC_010102.1 | NC_009379.1 | NC_011665.1 | NC_011733.1 | NC_013101 | NC_003634 |
| NC_011083.1 | NC_010531.1 | NC_009999.1 | NC_011734.1 | NC_003558 | NC_007069 |
| NC_011094.1 | NC_012526.1 | NC_009998.1 | NC_011882.1 | NC_003565 | NC_013220 |
| NC_011149.1 | NC_008570.1 | NC_010000.1 | NC_011885.1 | NC_003567 | NC_013221 |
| NC_011205.1 | NC_021290.1 | NC_017572.1 | NC_011880.1 | NC_003564 | NC_006447 |
| NC_011147.1 | NC_014215.1 | NC_017570.1 | NC_013160.1 | NC_003566 | NC_006439 |
| NC_016854.1 | NC_011831.1 | NC_016905.1 | NC_013167.1 | NC_003563 | NC_013797 |
| NC_016857.1 | NC_009718.1 | NC_017580.1 | NC_013168.1 | NC_003562 | NC_017916 |
| NC_016810.1 | NC_008701.1 | NC_017577.1 | NC_013163.1 | NC_003561 | NC_024015 |
| NC_016863.1 | NC_008027.1 | NC_017578.1 | NC_014502.1 | NC_003560 | NC_024011 |
| NC_016831.1 | NC_009434.1 | NC_015701.1 | NC_014535.1 | NC_003559 | NC_024010 |
| NC_016832.1 | NC_017532.1 | NC_015698.1 | NC_014533.1 | NC_023437 | NC_024014 |
| NC_017046.1 | NC_015740.1 | NC_015700.1 | NC_014503.1 | NC_011183 | NC_015626 |
| NC_017623.1 | NC_018028.1 | NC_015699.1 | NC_014534.1 | NC_013590 | NC_019850 |
| NC_016860.1 | NC_018177.1 | NC_021504.1 | NC_014504.1 | NC_022249 | NC_014648 |
| NC_020307.1 | NC_019936.1 | NC_021497.1 | NC_015390.1 | NC_017823 | NC_010178 |
| NC_021151.1 | NC_008593.1 | NC_021498.1 | NC_022602.1 | NC_022800 | NC_022365 |
| NC_021176.1 | NC_021314.1 | NC_021495.1 | NC_022601.1 | NC_001481 | NC_009020 |
| NC_021812.2 | NC_008610.1 | NC_021503.1 | NC_022607.1 | NC_001871 | NC_005897 |
| NC_021810.1 | NC_009486.1 | NC_021496.1 | NC_022603.1 | NC_001482 | NC_005894 |
| NC_021818.1 | NC_008343.1 | NC_006462.1 | NC_022608.1 | NC_002306 | NC_015639 |
| NC_021814.1 | NC_009463.1 | NC_006463.1 | NC_016646.1 | NC_001940 | NC_023423 |
| NC_021820.1 | NC_009715.1 | NC_005838.1 | NC_011667.1 | NC_016156 | NC_003220 |
| NC_021844.1 | NC_008212.1 | NC_017273.1 | NC_015498.1 | NC_022802 | NC_003219 |
| NC_021902.1 | NC_017459.1 | NC_017588.1 | NC_012230.1 | NC_021472 | NC_016564 |
| NC_021984.1 | NC_008786.1 | NC_017590.1 | NC_012242.1 | NC_022373 | NC_004289 |
| NC_022221.1 | NC_009616.1 | NC_009343.1 | NC_012260.1 | NC_004765 | NC_003849 |
| NC_022525.1 | NC_008229.1 | NC_007430.1 | NC_012239.1 | NC_014357 | NC_011539 |
| NC_022544.1 | NC_008347.1 | NC_017435.1 | NC_012252.1 | NC_005084 | NC_003779 |
| NC_022569.1 | NC_009511.1 | NC_017433.1 | NC_012267.1 | NC_022253 | NC_006960 |
| NC_022991.1 | NC_008278.1 | NC_017438.1 | NC_012234.1 | NC_017830 | NC_006961 |
| NZ_CM001062.1 | NC_010622.1 | NC_019272.1 | NC_012265.1 | NC_015494 | NC_009992 |
| NZ_CM001151.1 | NC_010623.1 | NC_020979.1 | NC_012247.1 | NC_015495 | NC_001445 |
| NZ_CM001153.1 | NC_009901.1 | NC_020947.1 | NC_013930.1 | NC_015229 | NC_002593 |
| NZ_CM001274.1 | NC_009952.1 | NC_020962.1 | NC_015679.1 | NC_003554 | NC_008349 |
| NZ_CM001471.1 | NC_011898.1 | NC_020989.1 | NC_013419.1 | NC_007163 | NC_006579 |
| NC_003143.1 | NC_009954.1 | NC_020951.1 | NC_016150.1 | NC_007161 | NC_011543 |
| NC_004088.1 | NC_010814.1 | NC_020952.1 | NC_016598.1 | NC_007157 | NC_002164 |
| NC_009381.1 | NC_009440.1 | NC_020984.1 | NC_017925.1 | NC_007156 | NC_018872 |
| NC_005810.1 | NC_009033.1 | NC_020956.1 | NC_020196.1 | NC_007160 | NC_014406 |
| NC_008149.1 | NC_010506.1 | NC_020983.1 | NC_022551.1 | NC_007158 | NC_014407 |
| NC_008150.1 | NC_009439.1 | NC_020957.1 | NC_013857.1 | NC_007154 | NC_005343 |
| NC_010159.1 | NC_015410.1 | NC_021051.1 | NC_013860.1 | NC_007162 | NC_018617 |
| NC_017154.1 | NC_009832.1 | NC_021049.1 | NC_013855.1 | NC_007159 | NC_023674 |
| NC_017160.1 | NC_010676.1 | NC_023057.1 | NC_013856.1 | NC_007155 | NC_019494 |
| NC_014029.1 | NC_010681.1 | NC_020946.1 | NC_013859.1 | NC_008522 | NC_023675 |
| NC_017265.1 | NC_009719.1 | NC_020986.1 | NC_013858.1 | NC_007923 | NC_023636 |
| NC_017168.1 | NC_011566.1 | NC_020958.1 | NZ_CM001370.1 | NC_006356 | NC_023673 |
| NC_007795.1 | NC_010003.1 | NC_020959.1 | NZ_CM001369.1 | NC_021867 | NC_016031 |
| NC_002745.2 | NC_011146.1 | NC_020987.1 | NC_013888.1 | NC_010757 | NC_016032 |
| NC_007622.1 | NC_009634.1 | NC_020960.1 | NC_015060.1 | NC_010759 | NC_016647 |
| NC_017333.1 | NC_009943.1 | NC_020988.1 | NC_015057.1 | NC_004144 | NC_013774 |

TABLE 4-continued

GenBank accession numbers of published prokaryote chromosome and plasmid sequences, and virus sequences (including entry version number ".N"; GenBank database release 202, 15 Jun. 2014)

| | | | | | |
|---|---|---|---|---|---|
| NC_002758.2 | NC_008942.1 | NC_020961.1 | NC_015058.1 | NC_004146 | NC_001792 |
| NC_009782.1 | NC_009073.1 | NC_020963.1 | NC_015059.1 | NC_020206 | NC_005148 |
| NC_003923.1 | NC_011229.1 | NC_020985.1 | NC_015065.1 | NC_004004 | NC_016990 |
| NC_002952.2 | NC_011244.1 | NC_020955.1 | NC_019686.1 | NC_023021 | NC_022233 |
| NC_002953.3 | NC_009465.1 | NC_020980.1 | NC_019679.1 | NC_023022 | NC_003059 |
| NC_002951.2 | NC_012633.1 | NC_020948.1 | NC_015459.1 | NC_013528 | NC_000940 |
| NC_007793.1 | NC_009900.1 | NC_020949.1 | NC_015974.1 | NC_021221 | NC_003436 |
| NC_009487.1 | NC_016931.1 | NC_020981.1 | NC_016747.1 | NC_001720 | NC_007732 |
| NC_010079.1 | NC_011420.2 | NC_020950.1 | NC_016746.1 | NC_015323 | NC_016769 |
| NC_009632.1 | NC_009712.1 | NC_020953.1 | NC_022536.1 | NC_000899 | NC_011829 |
| NC_013450.1 | NC_009635.1 | NC_020954.1 | NZ_ALIG01000010.1 | NC_014969 | NC_002702 |
| NC_017340.1 | NC_009328.1 | NC_020982.1 | NC_020303.1 | NC_002188 | NC_022104 |
| NC_017331.1 | NC_009831.1 | NC_020513.1 | NC_019016.1 | NC_001483 | NC_001718 |
| NC_017338.1 | NC_010376.1 | NC_020551.1 | NC_019017.1 | NC_009519 | NC_014665 |
| NC_017341.1 | NZ_CM000955.1 | NC_008545.1 | NC_019015.1 | NC_009521 | NC_023020 |
| NC_017342.1 | NC_009454.1 | NC_011003.1 | NC_022358.1 | NC_009520 | NC_023860 |
| NC_022113.1 | NC_023065.1 | NC_003080.1 | NZ_CM002140.1 | NC_006566 | NC_023176 |
| NC_017347.1 | NC_013009.1 | NC_007483.1 | NC_021920.1 | NC_006568 | NC_001961 |
| NC_017337.1 | NC_010168.1 | NC_006578.1 | NC_018696.1 | NC_006567 | NC_009640 |
| NC_016941.1 | NC_010163.1 | NC_008598.1 | NZ_AMRX01000008.1 | NC_013117 | NC_003987 |
| NC_016928.1 | NC_010085.1 | NC_014172.1 | NZ_APAS01000019.1 | NC_014546 | NC_021203 |
| NC_017349.1 | NC_013926.1 | NC_017199.1 | NZ_ANIN01000003.1 | NC_014064 | NC_021204 |
| NC_017351.1 | NC_003869.1 | NC_017201.1 | NC_020545.1 | NC_020906 | NC_023877 |
| NC_016912.1 | NC_016751.1 | NC_017212.1 | NC_020910.1 | NC_018091 | NC_023878 |
| NC_017343.1 | NC_015730.1 | NC_017206.1 | NC_020909.1 | NC_018090 | NC_003985 |
| NC_017763.1 | NC_014804.1 | NC_017202.1 | NC_021506.1 | NC_018453 | NC_022787 |
| NC_018608.1 | NC_011768.1 | NC_017203.1 | NC_019012.1 | NC_001362 | NC_023637 |
| NC_020533.1 | NC_010725.1 | NC_017210.1 | NC_021986.1 | NC_010954 | NC_023638 |
| NC_020566.1 | NC_010382.1 | NC_017204.1 | NC_022001.1 | NC_002501 | NC_008714 |
| NC_020568.1 | NC_009464.1 | NC_017211.1 | NC_019698.1 | NC_005946 | NC_009759 |
| NC_021554.1 | NC_010644.1 | NC_017209.1 | NC_020053.1 | NC_001403 | NC_008605 |
| NC_021670.1 | NZ_ABCY02000001.1 | NC_017207.1 | NC_019730.1 | NC_023879 | NC_003632 |
| NC_022222.1 | NC_011144.1 | NC_017205.1 | NC_019763.1 | NC_020469 | NC_022799 |
| NC_022226.1 | NC_009613.3 | NC_018487.1 | NC_019732.1 | NC_006937 | NC_022798 |
| NC_022442.1 | NC_010830.1 | NC_018486.1 | NC_019731.1 | NC_013469 | NC_011525 |
| NC_022443.1 | NC_010571.1 | NC_018501.1 | NC_019764.1 | NC_013471 | NC_001747 |
| NC_022604.1 | NC_011886.1 | NC_018488.1 | NC_019777.1 | NC_013470 | NC_003725 |
| NC_017673.1 | NC_010524.1 | NC_018489.1 | NZ_ASXA01000016.1 | NC_023680 | NC_003724 |
| NC_021059.1 | NC_009714.1 | NC_018490.1 | NC_021742.1 | NC_003883 | NC_003723 |
| NZ_CM000952.1 | NC_015145.1 | NC_018503.1 | NC_019953.1 | NC_003884 | NC_004039 |
| NC_004461.1 | NC_010655.1 | NC_018502.1 | NC_021832.1 | NC_001710 | NC_018175 |
| NC_002976.3 | NC_010718.1 | NC_018512.1 | NC_020553.1 | NC_023892 | NC_001361 |
| NC_002662.1 | NC_011999.1 | NC_018516.1 | NC_020523.1 | NC_001818 | NC_007289 |
| NC_009004.1 | NC_020133.1 | NC_018510.1 | NC_022436.1 | NC_004286 | NC_011062 |
| NC_008527.1 | NC_010334.1 | NC_018517.1 | NC_020275.1 | NC_006623 | NC_004010 |
| NC_013656.1 | NC_011894.1 | NC_018509.1 | NC_020276.1 | NC_002229 | NC_011620 |
| NC_017949.1 | NC_010694.1 | NC_018511.1 | NC_021918.1 | NC_002577 | NC_001616 |
| NC_017486.1 | NC_011666.1 | NC_018685.1 | NC_022782.1 | NC_016440 | NC_016136 |
| NC_017492.1 | NC_011529.1 | NC_018687.1 | NC_022783.1 | NC_003557 | NC_002048 |
| NC_019435.1 | NC_010581.1 | NC_018694.1 | NZ_CM002284.1 | NC_003375 | NC_002049 |
| NC_020450.1 | NC_012108.1 | NC_018684.1 | NZ_CM002283.1 | NC_003376 | NC_004644 |
| NC_022369.1 | NC_010424.1 | NC_018688.1 | NZ_CM002282.1 | NC_022961 | NC_004638 |
| NC_004722.1 | NC_012489.1 | NC_018686.1 | NZ_CM002281.1 | NC_004012 | NC_001934 |
| NC_003909.8 | NC_012490.1 | NC_018689.1 | NZ_CM002286.1 | NC_001800 | NC_001935 |
| NC_006274.1 | NC_007204.1 | NC_018885.1 | NC_019014.1 | NC_020472 | NC_006061 |
| NC_011969.1 | NC_007955.1 | NC_018883.1 | NC_016900.1 | NC_012135 | NC_006062 |
| NC_011725.1 | NC_007298.1 | NC_018884.1 | NC_016021.1 | NC_012134 | NC_006063 |
| NC_011658.1 | NC_019567.1 | NC_018882.1 | NC_016028.1 | NC_012136 | NC_000939 |
| NC_011772.1 | NC_005363.1 | NC_018879.1 | NC_016037.1 | NC_020252 | NC_023849 |
| NC_011773.1 | NC_005362.1 | NC_018881.1 | NC_016029.1 | NC_023612 | NC_003687 |
| NC_012472.1 | NC_013504.1 | NC_018886.1 | NC_016022.1 | NC_008376 | NC_007815 |
| NC_014335.1 | NC_017477.1 | NC_018880.1 | NC_016030.1 | NC_009552 | NC_013109 |
| NC_016779.1 | NC_022909.1 | NC_018878.1 | NC_018606.1 | NC_006558 | NC_013110 |
| NC_016771.1 | NC_014033.1 | NC_020243.1 | NC_009340.1 | NC_003555 | NC_020847 |
| NC_018491.1 | NZ_ABIZ01000001.1 | NC_020242.1 | NC_009339.1 | NC_001885 | NC_020845 |
| NZ_CM000714.1 | NC_005877.1 | NC_020241.1 | NC_009341.1 | NC_010306 | NC_020878 |
| NZ_CM000741.1 | NC_014000.1 | NC_020239.1 | NZ_AQHN01000096.1 | NC_010356 | NC_015280 |
| NZ_CM000715.1 | NC_007413.1 | NC_020240.1 | NZ_AQHN01000095.1 | NC_008922 | NC_015284 |
| NZ_CM000716.1 | NC_007294.1 | NC_020249.1 | NC_017858.1 | NC_008877 | NC_015283 |
| NZ_CM000717.1 | NC_006142.1 | NC_020250.1 | NC_014144.1 | NC_008878 | NC_006883 |
| NZ_CM000718.1 | NC_017066.1 | NC_020392.1 | NC_016115.1 | NC_008936 | NC_021559 |
| NZ_CM000719.1 | NC_017062.1 | NC_020382.1 | NC_016110.1 | NC_008879 | NC_006884 |
| NZ_CM000720.1 | NC_006908.1 | NC_020383.1 | NZ_BAWN01000094.1 | NC_008880 | NC_015290 |
| NZ_CM000721.1 | NC_006512.1 | NC_020379.1 | NC_019002.1 | NC_008881 | NC_020835 |
| NZ_CM000722.1 | NC_021286.1 | NC_020393.1 | NZ_AZLZ01002924.1 | NC_008849 | NC_020874 |
| NZ_CM000723.1 | NC_013385.1 | NC_020384.1 | NZ_CM000956.1 | NC_008882 | NC_006882 |

TABLE 4-continued

GenBank accession numbers of published prokaryote
chromosome and plasmid sequences, and virus sequences (including
entry version number ".N"; GenBank database release 202, 15 Jun. 2014)

| | | | | | |
|---|---|---|---|---|---|
| NZ_CM000724.1 | NC_006177.1 | NC_020377.1 | NZ_CM002260.1 | NC_008883 | NC_015288 |
| NZ_CM000725.1 | NC_008260.1 | NC_020390.1 | NZ_CM001862.1 | NC_008935 | NC_015285 |
| NZ_CM000726.1 | NC_009633.1 | NC_020380.1 | NZ_AZLY01000050.1 | NC_008919 | NC_007150 |
| NZ_CM000727.1 | NC_007512.1 | NC_020391.1 | NZ_AZME01000385.1 | NC_008920 | NC_024018 |
| NZ_CM000728.1 | NC_008687.1 | NC_020378.1 | NC_020538.1 | NC_008921 | NC_018851 |
| NZ_CM000729.1 | NC_008686.1 | NC_020381.1 | NC_020567.1 | NC_008876 | NC_018847 |
| NZ_CM000730.1 | NC_006510.1 | NC_020385.1 | NC_020565.1 | NC_008906 | NC_003460 |
| NZ_CM000731.1 | NC_014970.1 | NC_020394.1 | NC_020531.1 | NC_008923 | NC_018842 |
| NZ_CM000732.1 | NC_017520.1 | NC_022876.1 | NC_020530.1 | NC_008924 | NC_018852 |
| NZ_CM000733.1 | NC_007576.1 | NC_022874.1 | NC_021977.1 | NC_008925 | NC_018840 |
| NZ_CM000734.1 | NC_013222.1 | NC_022882.1 | NC_021979.1 | NC_008907 | NC_018838 |
| NZ_CM000735.1 | NC_023134.1 | NC_022875.1 | NC_021978.1 | NC_008908 | NC_018841 |
| NZ_CM000736.1 | NC_014414.1 | NC_022877.1 | NC_021993.1 | NC_008909 | NC_018845 |
| NZ_CM000737.1 | NZ_CM002299.1 | NC_020124.1 | NC_021976.1 | NC_008863 | NC_018849 |
| NZ_CM000738.1 | NC_008710.1 | NC_003296.1 | NC_021992.1 | NC_008911 | NC_018839 |
| NZ_CM000739.1 | NC_015138.1 | NC_017575.1 | NC_022778.1 | NC_008940 | NC_018834 |
| NZ_CM000740.1 | NC_007482.1 | NC_014310.1 | NC_022540.1 | NC_008912 | NC_009541 |
| NZ_CM001787.1 | NC_007481.1 | NC_021745.1 | NC_022542.1 | NC_008926 | NC_015454 |
| NC_003366.1 | NC_008358.1 | NC_017589.1 | NC_022539.1 | NC_008864 | NC_015453 |
| NC_008261.1 | NC_009850.1 | NC_017558.1 | NC_021843.1 | NC_008887 | NC_022336 |
| NC_008262.1 | NC_021878.1 | NZ_CM002756.1 | NC_021815.1 | NC_008892 | NC_022339 |
| NC_008265.1 | NC_017187.1 | NZ_CM002758.1 | NC_021816.1 | NC_008891 | NC_022338 |
| NZ_CM001477.1 | NC_009051.1 | NC_007608.1 | Viruses RefSeq | NC_008888 | NC_022335 |
| NC_003210.1 | NC_013722.1 | NC_010672.1 | NC_010318 | NC_008886 | NC_022337 |
| NC_002973.6 | NC_011617.1 | NC_010656.1 | NC_010317 | NC_008850 | NC_022342 |
| NC_011660.1 | NC_014751.1 | NC_010657.1 | NC_010314 | NC_008884 | NC_022334 |
| NC_013768.1 | NC_017521.1 | NC_010660.1 | NC_010319 | NC_008890 | NC_022341 |
| NC_012488.1 | NC_011653.1 | NC_010659.1 | NC_010316 | NC_008937 | NC_022340 |
| NC_013766.1 | NC_010617.1 | NC_005916.1 | NC_010315 | NC_008889 | NC_014126 |
| NC_017546.1 | NC_015711.1 | NZ_AGBV01000006.1 | NC_018874 | NC_008885 | NC_018832 |
| NC_017547.1 | NC_016948.1 | NZ_ALIF01000007.1 | NC_011646 | NC_008933 | NC_008037 |
| NC_017545.1 | NC_016946.1 | NC_005297.1 | NC_001499 | NC_008927 | NC_008038 |
| NC_017544.1 | NC_016947.1 | NC_007489.1 | NC_014139 | NC_008865 | NC_008039 |
| NC_021829.1 | NC_014010.1 | NC_009007.1 | NC_014138 | NC_008866 | NC_004363 |
| NC_021830.1 | NC_010162.1 | NC_009008.1 | NC_015045 | NC_008867 | NC_004364 |
| NC_018587.1 | NC_021658.1 | NC_007488.2 | NC_015048 | NC_008868 | NC_004362 |
| NC_017529.1 | NC_010170.1 | NC_007490.2 | NC_016577 | NC_008870 | NC_013772 |
| NC_018588.1 | NC_011766.1 | NC_009040.1 | NC_016574 | NC_008871 | NC_015293 |
| NC_017537.1 | NC_011567.1 | NC_009430.1 | NC_001929 | NC_008872 | NC_000867 |
| NC_017728.1 | NC_010995.1 | NC_009432.1 | NC_001928 | NC_008873 | NC_021300 |
| NC_018586.1 | NC_014814.1 | NC_009433.1 | NC_014649 | NC_008848 | NC_020849 |
| NC_018593.1 | NC_013508.1 | NC_009429.1 | NC_020104 | NC_008893 | NC_013804 |
| NC_018589.1 | NC_017309.1 | NC_009431.1 | NC_008724 | NC_008874 | NC_004665 |
| NC_018584.1 | NZ_CM000950.1 | NC_011962.1 | NC_020099 | NC_008875 | NC_007807 |
| NC_018592.1 | NZ_CM000951.1 | NC_011960.1 | NC_004290 | NC_008843 | NC_011703 |
| NC_018590.1 | NC_014614.1 | NZ_CM001163.1 | NC_022564 | NC_008914 | NC_010821 |
| NC_018642.1 | NC_020449.1 | NZ_CM001164.1 | NC_021074 | NC_008915 | NC_007806 |
| NC_018585.1 | NC_011386.1 | NZ_AKVW01000004.1 | NC_001447 | NC_008916 | NC_019923 |
| NC_019556.1 | NC_015684.1 | NZ_AKVW01000006.1 | NC_001341 | NC_008917 | NC_006548 |
| NC_020557.1 | NC_017538.1 | NZ_AKVW01000005.1 | NC_023556 | NC_008903 | NC_016764 |
| NC_020558.1 | NC_013791.2 | NZ_AKVW01000003.1 | NC_009452 | NC_008837 | NC_022974 |
| NC_021838.1 | NC_010794.1 | NZ_AKVW01000007.1 | NC_005830 | NC_008846 | NC_002484 |
| NC_021823.1 | NC_015428.1 | NZ_AKBU01000004.1 | NC_009884 | NC_008838 | NC_005178 |
| NC_021824.1 | NC_018610.1 | NZ_AKBU01000005.1 | NC_010155 | NC_008839 | NC_008717 |
| NC_021837.1 | NC_014014.1 | NZ_AKBU01000003.1 | NC_010152 | NC_008840 | NC_007623 |
| NC_021825.1 | NC_011565.1 | NC_010635.1 | NC_010153 | NC_008841 | NC_007805 |
| NC_021826.1 | NC_014109.1 | NC_006153.2 | NC_010154 | NC_008842 | NC_006552 |
| NC_021839.1 | NC_012781.1 | NC_006154.1 | NC_010537 | NC_008913 | NC_007810 |
| NC_021827.1 | NC_021010.1 | NC_009704.1 | NC_009965 | NC_008844 | NC_020203 |
| NC_021840.1 | NC_021044.1 | NC_009705.1 | NC_013585 | NC_008845 | NC_020198 |
| NC_022568.1 | NC_012491.1 | NC_014728.1 | NC_007409 | NC_008847 | NC_020202 |
| NC_018591.1 | NC_014388.1 | NC_003921.3 | NC_017984 | NC_008869 | NC_020200 |
| NZ_CM001159.1 | NC_014387.1 | NC_003922.1 | NC_015250 | NC_008862 | NC_019450 |
| NZ_CM001469.1 | NC_011661.1 | NC_020816.1 | NC_021337 | NC_008861 | NC_017674 |
| NC_002944.2 | NC_011901.1 | NC_020817.1 | NC_002700 | NC_008860 | NC_015272 |
| NC_008595.1 | NC_010545.1 | NC_007713.1 | NC_021316 | NC_008859 | NC_019935 |
| NC_021200.1 | NC_020230.1 | NC_007714.1 | NC_014660 | NC_008858 | NC_011165 |
| NC_002945.3 | NC_011027.1 | NC_007715.1 | NC_014661 | NC_008934 | NC_013692 |
| NC_008769.1 | NC_011026.1 | NC_008226.1 | NC_014663 | NC_008856 | NC_009936 |
| NC_012207.1 | NC_011832.1 | NC_017176.1 | NC_019541 | NC_008855 | NC_009935 |
| NC_016804.1 | NC_012034.1 | NC_008386.1 | NC_023590 | NC_008898 | NC_011166 |
| NC_020245.2 | NC_012785.1 | NC_008389.1 | NC_023570 | NC_008928 | NC_010326 |
| NC_004572.3 | NC_013194.1 | NC_008388.1 | NC_023581 | NC_008941 | NC_010325 |
| NC_004551.1 | NC_012985.3 | NC_008387.1 | NC_018087 | NC_008929 | NC_013691 |
| NC_009053.1 | NC_020549.1 | NC_007337.1 | NC_002795 | NC_008930 | NC_017972 |
| NC_010278.1 | NC_010544.1 | NC_007336.1 | NC_016404 | NC_008931 | NC_007809 |

TABLE 4-continued

GenBank accession numbers of published prokaryote
chromosome and plasmid sequences, and virus sequences (including
entry version number ".N"; GenBank database release 202, 15 Jun. 2014)

| | | | | | |
|---|---|---|---|---|---|
| NC_010939.1 | NC_021236.1 | NC_004923.1 | NC_009643 | NC_008932 | NC_018282 |
| NC_005042.1 | NC_012881.1 | NC_004925.1 | NC_005885 | NC_008910 | NC_009818 |
| NC_005072.1 | NC_010673.1 | NC_004924.1 | NC_002548 | NC_008894 | NC_011613 |
| NC_005071.1 | NZ_CM000745.1 | NC_009350.1 | NC_003780 | NC_008938 | NC_011611 |
| NC_007335.2 | NC_013720.1 | NC_009349.1 | NC_002077 | NC_008895 | NC_018274 |
| NC_007577.1 | NC_011992.1 | NC_004704.1 | NC_001401 | NC_008896 | NC_022746 |
| NC_008816.1 | NC_015578.1 | NC_009726.1 | NC_001729 | NC_008897 | NC_022091 |
| NC_008817.1 | NC_015577.1 | NC_010115.1 | NC_001829 | NC_008857 | NC_019451 |
| NC_008819.1 | NC_013205.1 | NC_011526.1 | NC_006152 | NC_008899 | NC_016571 |
| NC_008820.1 | NC_017167.1 | NC_010258.1 | NC_006260 | NC_008851 | NC_023700 |
| NC_009091.1 | NC_012522.1 | NC_008502.1 | NC_006261 | NC_008900 | NC_007808 |
| NC_009840.1 | NC_012792.1 | NC_011352.1 | NC_021247 | NC_008901 | NC_011373 |
| NC_009976.1 | NC_012791.1 | NC_017476.1 | NC_004690 | NC_008902 | NC_015294 |
| NC_000907.1 | NC_014931.1 | NC_017475.1 | NC_005038 | NC_008918 | NC_022967 |
| NC_007146.2 | NC_022247.1 | NC_020057.1 | NC_011423 | NC_008904 | NC_022970 |
| NC_009566.1 | NC_022234.1 | NC_021722.1 | NC_007557 | NC_008905 | NC_022986 |
| NC_009567.1 | NC_012962.1 | NC_005863.1 | NC_007558 | NC_008852 | NC_022966 |
| NC_017451.1 | NC_015714.1 | NC_008741.1 | NC_007551 | NC_008853 | NC_011810 |
| NC_017452.1 | NC_013922.1 | NC_017311.1 | NC_007556 | NC_008854 | NC_001628 |
| NC_014920.1 | NC_011313.1 | NZ_ANIP01000001.1 | NC_007552 | NC_008939 | NC_023006 |
| NC_014922.1 | NC_011312.1 | NC_009136.1 | NC_007553 | NC_004003 | NC_023005 |
| NC_016809.1 | NC_014002.1 | NC_010683.1 | NC_007554 | NC_018482 | NC_008294 |
| NC_022356.1 | NC_011295.1 | NC_012851.1 | NC_007555 | NC_018483 | NC_011107 |
| NC_000962.3 | NC_011297.1 | NC_012855.1 | NC_007548 | NC_017979 | NC_011105 |
| NC_002755.2 | NC_011296.1 | NC_012849.1 | NC_007550 | NC_003054 | NC_022096 |
| NC_009525.1 | NC_014541.1 | NC_017468.1 | NC_007549 | NC_004800 | NC_019913 |
| NC_009565.1 | NC_014248.1 | NC_020277.1 | NC_012636 | NC_005036 | NC_005884 |
| NC_012943.1 | NC_012559.1 | NC_017228.1 | NC_004285 | NC_001701 | NC_004466 |
| NC_022350.1 | NC_012997.1 | NC_017239.1 | NC_012932 | NC_018105 | NC_001331 |
| NC_016768.1 | NC_022663.1 | NC_017230.1 | NC_007669 | NC_016435 | NC_001418 |
| NC_018078.1 | NC_014377.1 | NC_017227.1 | NC_007674 | NC_015720 | NC_021062 |
| NC_017524.1 | NC_013422.1 | NC_017231.1 | NC_007673 | NC_016434 | NC_011756 |
| NC_017523.1 | NC_012917.1 | NC_017232.1 | NC_007672 | NC_016166 | NC_023596 |
| NC_017522.1 | NC_018525.1 | NC_017226.1 | NC_007668 | NC_013013 | NC_023583 |
| NC_018143.2 | NC_012751.1 | NC_017235.1 | NC_007667 | NC_011804 | NC_018850 |
| NC_020089.1 | NC_012225.1 | NC_017237.1 | NC_007670 | NC_013011 | NC_010116 |
| NC_020559.1 | NC_013421.1 | NC_017233.1 | NC_007666 | NC_013012 | NC_013638 |
| NC_021054.1 | NC_012912.1 | NC_017225.1 | NC_007671 | NC_012120 | NC_004174 |
| NC_021192.1 | NZ_CM001858.1 | NC_017236.1 | NC_008208 | NC_011805 | NC_004175 |
| NC_021193.1 | NC_014098.1 | NC_017229.1 | NC_007022 | NC_011535 | NC_004173 |
| NC_021194.1 | NC_014506.1 | NC_017234.1 | NC_005135 | NC_018384 | NC_004171 |
| NC_021251.1 | NC_013715.1 | NC_017224.1 | NC_015251 | NC_018383 | NC_004170 |
| NC_021740.1 | NC_014106.1 | NC_017241.1 | NC_005260 | NC_015492 | NC_004172 |
| NC_016934.1 | NC_020990.1 | NC_017240.1 | NC_020879 | NC_015493 | NC_015208 |
| NZ_CM000787.2 | NC_013416.1 | NC_008566.1 | NC_019543 | NC_015782 | NC_012091 |
| NZ_CM000788.2 | NC_013597.1 | NC_008565.1 | NC_019538 | NC_012484 | NC_012092 |
| NZ_CM000789.2 | NC_017846.1 | NC_008273.1 | NC_023688 | NC_015220 | NC_012093 |
| NZ_CM001043.1 | NC_016513.1 | NC_008274.1 | NC_014635 | NC_003621 | NC_016762 |
| NZ_CM001044.1 | NC_016632.1 | NC_008567.1 | NC_014636 | NC_003622 | NC_003716 |
| NZ_CM001045.1 | NC_013118.1 | NC_008568.1 | NC_019528 | NC_017938 | NC_003714 |
| NZ_CM001225.1 | NC_013119.1 | NC_008564.1 | NC_009542 | NC_017939 | NC_003715 |
| NZ_CM001226.1 | NC_013851.1 | NC_008569.1 | NC_019527 | NC_019493 | NC_003300 |
| NZ_CM001227.1 | NC_014632.1 | NC_011794.1 | NC_001467 | NC_003623 | NC_003299 |
| NZ_CM001515.1 | NC_013741.1 | NC_011651.1 | NC_001468 | NC_003615 | NC_003301 |
| NZ_CM002022.1 | NC_014964.1 | NC_011650.1 | NC_022519 | NC_003203 | NC_003278 |
| NZ_CM002048.1 | NC_014011.1 | NC_011788.1 | NC_004763 | NC_003347 | NC_022971 |
| NZ_CM002049.1 | NC_014537.1 | NC_011787.1 | NC_010820 | NC_017918 | NC_015264 |
| NZ_CM002050.1 | NC_017455.1 | NC_011793.1 | NC_006017 | NC_016509 | NC_005045 |
| NZ_CM002051.1 | NC_014166.1 | NC_011789.1 | NC_006016 | NC_011702 | NC_004629 |
| NZ_CM002052.1 | NC_014816.1 | NC_011649.1 | NC_005996 | NC_007448 | NC_023601 |
| NZ_CM002053.1 | NC_014817.1 | NC_011790.1 | NC_006009 | NC_004667 | NC_023718 |
| NZ_CM002054.1 | NC_014393.1 | NC_011647.1 | NC_006021 | NC_016416 | NC_012418 |
| NZ_CM002055.1 | NC_014122.1 | NC_011786.1 | NC_006019 | NC_016081 | NC_017971 |
| NZ_CM002057.1 | NC_013156.1 | NC_011648.1 | NC_006012 | NC_016417 | NC_017864 |
| NZ_CM002056.1 | NC_014364.1 | NC_011792.1 | NC_006018 | NC_016436 | NC_017865 |
| NZ_CM002058.1 | NC_013532.1 | NC_011791.1 | NC_006011 | NC_022002 | NC_019918 |
| NZ_CM002059.1 | NC_014378.1 | NC_011758.1 | NC_006020 | NC_004724 | NC_023575 |
| NZ_CM002060.1 | NC_014962.1 | NC_011760.1 | NC_012519 | NC_001948 | NC_019813 |
| NZ_CM002061.1 | NC_014394.1 | NC_012810.1 | NC_001659 | NC_021480 | NC_016765 |
| NZ_CM002062.1 | NC_014972.1 | NC_012807.1 | NC_021202 | NC_015784 | NC_019492 |
| NZ_CM002063.1 | NC_013407.1 | NC_012809.1 | NC_019547 | NC_003604 | NC_005264 |
| NZ_CM002064.1 | NZ_CM001376.1 | NC_012811.1 | NC_003434 | NC_003602 | NC_023734 |
| NZ_CM002065.1 | NC_013921.1 | NC_012989.1 | NC_022127 | NC_011106 | NC_020841 |
| NZ_CM002066.1 | NC_013959.1 | NC_012987.1 | NC_022129 | NC_018458 | NC_020070 |
| NZ_CM002067.1 | NC_014410.1 | NC_012624.1 | NC_022128 | NC_014531 | NC_010946 |
| NZ_CM002068.1 | NC_019970.1 | NC_013770.1 | NC_014746 | NC_014524 | NC_021864 |

TABLE 4-continued

GenBank accession numbers of published prokaryote
chromosome and plasmid sequences, and virus sequences (including
entry version number ".N"; GenBank database release 202, 15 Jun. 2014)

| | | | | | |
|---|---|---|---|---|---|
| NZ_CM002069.1 | NC_012982.1 | NC_010502.1 | NC_014744 | NC_014523 | NC_005224 |
| NZ_CM002070.1 | NC_012969.1 | NC_010504.1 | NC_012557 | NC_014530 | NC_005223 |
| NZ_CM002073.1 | NC_014313.1 | NC_010510.1 | NC_014645 | NC_014522 | NC_005225 |
| NZ_CM002071.1 | NC_021172.1 | NC_010518.1 | NC_020889 | NC_014525 | NC_023894 |
| NZ_CM002072.1 | NC_014209.1 | NC_010509.1 | NC_006384 | NC_014526 | NC_005872 |
| NZ_CM002076.1 | NC_014471.1 | NC_010517.1 | NC_005046 | NC_014527 | NC_009597 |
| NZ_CM002077.1 | NC_014008.1 | NC_010514.1 | NC_023443 | NC_014528 | NC_016403 |
| NZ_CM002079.1 | NC_011740.1 | NC_010507.1 | NC_007067 | NC_014529 | NC_012671 |
| NZ_CM002074.1 | NZ_CM001142.1 | NZ_AVAB01000114.1 | NC_004090 | NC_003876 | NC_009889 |
| NZ_CM002075.1 | NC_018073.1 | NZ_AVAB01000116.1 | NC_010812 | NC_005965 | NC_011704 |
| NZ_CM002078.1 | NC_022246.1 | NZ_AVAB01000115.1 | NC_003414 | NC_004018 | NC_017083 |
| NZ_CM002080.1 | NC_022237.1 | NZ_AVAB01000112.1 | NC_002981 | NC_004019 | NC_001266 |
| NZ_CM002127.1 | NZ_CM001889.1 | NZ_AVAB01000113.1 | NC_004627 | NC_004020 | NC_001543 |
| NZ_CM002126.1 | NC_017765.1 | NZ_AVAB01000111.1 | NC_003403 | NC_006444 | NC_008580 |
| NZ_CM002125.1 | NC_020895.1 | NZ_AVAB01000110.1 | NC_004626 | NC_006445 | NC_001542 |
| NZ_CM002124.1 | NC_014216.1 | NC_009466.1 | NC_013597 | NC_006446 | NC_023845 |
| NZ_CM002122.1 | NC_013849.1 | NC_011836.1 | NC_019519 | NC_006264 | NC_004323 |
| NZ_CM002121.1 | NC_014153.1 | NC_015407.1 | NC_005903 | NC_007920 | NC_010239 |
| NZ_CM002120.1 | NC_013642.1 | NC_018423.1 | NC_011345 | NC_001484 | NC_010238 |
| NZ_CM002123.1 | NC_012804.1 | NC_018422.1 | NC_005839 | NC_003620 | NC_010710 |
| NZ_CM002119.1 | NC_014205.1 | NC_018421.1 | NC_007921 | NC_003614 | NC_010709 |
| NZ_CM002114.1 | NC_013740.1 | NC_023143.1 | NC_015451 | NC_003619 | NC_023586 |
| NZ_CM002116.1 | NC_014658.1 | NC_023141.1 | NC_015450 | NC_015467 | NC_015297 |
| NZ_CM002118.1 | NC_015514.1 | NC_023139.1 | NC_015452 | NC_015468 | NC_009382 |
| NZ_CM002115.1 | NC_015671.1 | NC_023142.1 | NC_001918 | NC_015469 | NC_011201 |
| NZ_CM002117.1 | NC_015675.1 | NC_023148.1 | NC_018465 | NC_003603 | NC_023736 |
| NZ_CM002113.1 | NC_012691.1 | NC_023138.1 | NC_018460 | NC_002738 | NC_022917 |
| NZ_CM002111.1 | NZ_CM000770.1 | NC_023140.1 | NC_018459 | NC_009240 | NC_022915 |
| NZ_CM002109.1 | NC_013799.1 | NC_020907.1 | NC_009895 | NC_005077 | NC_010811 |
| NZ_CM002112.1 | NC_017161.1 | NC_006842.1 | NC_009894 | NC_005082 | NC_008574 |
| NZ_CM002108.1 | NC_012883.1 | NC_011185.1 | NC_009896 | NC_020502 | NC_011399 |
| NZ_CM002110.1 | NC_015943.1 | NC_009496.1 | NC_002531 | NC_001998 | NC_019548 |
| NZ_CM002107.1 | NC_015948.1 | NC_009700.1 | NC_001662 | NC_008521 | NC_008575 |
| NZ_CM002106.1 | NC_023010.2 | NC_010379.1 | NC_002024 | NC_018401 | NC_021866 |
| NZ_CM002105.1 | NC_023013.1 | NC_010418.1 | NC_002025 | NC_017091 | NC_021862 |
| NZ_CM002104.1 | NC_013790.1 | NC_010680.1 | NC_001495 | NC_022788 | NC_005131 |
| NZ_CM002102.1 | NC_012214.1 | NC_012657.1 | NC_010736 | NC_022789 | NC_010792 |
| NZ_CM002103.1 | NC_017390.1 | NC_012654.1 | NC_004355 | NC_001358 | NC_010791 |
| NZ_CM002101.1 | NC_014306.1 | NC_017298.1 | NC_010947 | NC_013443 | NC_021930 |
| NZ_CM002100.1 | NC_012121.1 | NC_015427.1 | NC_024009 | NC_021786 | NC_008211 |
| NZ_CM002098.1 | NC_012846.1 | NC_015419.1 | NC_012211 | NC_004827 | NC_008210 |
| NZ_CM002099.1 | NC_014448.1 | NC_015417.1 | NC_010253 | NC_001697 | NC_008191 |
| NZ_CM002097.1 | NC_017519.1 | NC_015418.1 | NC_010249 | NC_003315 | NC_008190 |
| NC_000913.3 | NC_016829.1 | NC_015426.1 | NC_001678 | NC_019455 | NC_010345 |
| NC_002695.1 | NC_019552.1 | NC_012946.1 | NC_001676 | NC_016418 | NC_010343 |
| NC_011750.1 | NC_022807.1 | NC_012945.1 | NC_001694 | NC_016989 | NC_010344 |
| NC_017634.1 | NC_014160.1 | NZ_AESA01000588.1 | NC_001352 | NC_013758 | NC_011705 |
| NC_018658.1 | NC_012913.1 | NZ_AOSX01000021.1 | NC_001357 | NC_023592 | NC_011706 |
| NC_011751.1 | NC_015850.1 | NC_010070.1 | NC_007408 | NC_007217 | NC_015455 |
| NC_004431.1 | NC_013960.1 | NC_010802.1 | NC_007731 | NC_017975 | NC_003740 |
| NC_012892.2 | NC_014363.1 | NC_009672.1 | NC_009562 | NC_017090 | NC_003739 |
| NC_007779.1 | NC_014375.1 | NC_009670.1 | NC_007211 | NC_010342 | NC_014601 |
| NC_011415.1 | NC_013894.1 | NC_009671.1 | NC_010990 | NC_021537 | NC_014598 |
| NC_013654.1 | NC_014100.1 | NC_009669.1 | NC_010989 | NC_003345 | NC_014607 |
| NC_013353.1 | NZ_CM000953.1 | NC_001904.1 | NC_010991 | NC_012558 | NC_014599 |
| NC_013364.1 | NC_015975.1 | NC_000949.1 | NC_010984 | NC_017087 | NC_014600 |
| NC_007946.1 | NC_014370.1 | NC_000951.1 | NC_021532 | NC_017088 | NC_014605 |
| NC_008253.1 | NC_014371.1 | NC_001852.1 | NC_010251 | NC_017089 | NC_014602 |
| NC_008563.1 | NC_013721.1 | NC_000954.1 | NC_010247 | NC_021330 | NC_014603 |
| NC_009801.1 | NC_014644.1 | NC_001857.2 | NC_009944 | NC_021319 | NC_014604 |
| NC_009800.1 | NC_017456.1 | NC_001856.1 | NC_009947 | NC_021327 | NC_014606 |
| NC_012967.1 | NC_014643.1 | NC_001849.2 | NC_009946 | NC_004927 | NC_008585 |
| NC_010468.1 | NZ_CM001774.1 | NC_001851.1 | NC_009945 | NC_021328 | NC_005267 |
| NC_010473.1 | NC_016630.1 | NC_000948.1 | NC_006440 | NC_021322 | NC_005266 |
| NC_010498.1 | NC_022112.1 | NC_001855.1 | NC_006441 | NC_021340 | NC_012936 |
| NC_011353.1 | NC_014246.1 | NC_001850.1 | NC_018402 | NC_021329 | NC_016442 |
| NC_013008.1 | NC_021012.1 | NC_000957.1 | NC_018403 | NC_021320 | NC_001819 |
| NC_012759.1 | NC_021040.1 | NC_000956.1 | NC_018404 | NC_021335 | NC_008375 |
| NC_012971.2 | NC_017761.1 | NC_000950.1 | NC_005832 | NC_021321 | NC_022630 |
| NC_017625.1 | NC_020555.1 | NC_001854.1 | NC_022755 | NC_021471 | NC_022631 |
| NC_012947.1 | NC_015437.1 | NC_001853.1 | NC_010586 | NC_020159 | NC_022632 |
| NC_013941.1 | NC_020164.1 | NC_000955.2 | NC_010587 | NC_020158 | NC_022616 |
| NC_017628.1 | NC_012590.1 | NC_000953.1 | NC_010588 | NC_020998 | NC_022617 |
| NC_011748.1 | NC_014659.1 | NC_000952.1 | NC_010584 | NC_022611 | NC_021097 |
| NC_011741.1 | NZ_CM001149.1 | NC_001903.1 | NC_010589 | NC_001663 | NC_021096 |
| NC_011742.1 | NZ_CM001024.1 | NC_011782.1 | NC_010593 | NC_020899 | NC_003741 |

TABLE 4-continued

GenBank accession numbers of published prokaryote chromosome and plasmid sequences, and virus sequences (including entry version number ".N"; GenBank database release 202, 15 Jun. 2014)

| | | | | | |
|---|---|---|---|---|---|
| NC_011601.1 | NC_015601.1 | NC_011722.1 | NC_010590 | NC_005222 | NC_003738 |
| NC_017626.1 | NZ_CM000961.1 | NC_011731.1 | NC_010591 | NC_005218 | NC_003775 |
| NC_013361.1 | NC_014217.1 | NC_011735.1 | NC_010592 | NC_005219 | NC_003756 |
| NC_016902.1 | NC_014639.1 | NC_011720.1 | NC_010585 | NC_006437 | NC_012210 |
| NC_017631.1 | NC_013850.1 | NC_011778.1 | NC_010594 | NC_006433 | NC_008041 |
| NC_017632.1 | NC_014168.1 | NC_011780.1 | NC_017859 | NC_006435 | NC_008040 |
| NC_017635.1 | NC_016803.1 | NC_011784.1 | NC_003453 | NC_015394 | NC_009041 |
| NC_017633.1 | NC_014220.1 | NC_011783.1 | NC_003452 | NC_015395 | NC_001803 |
| NC_017641.1 | NC_014759.1 | NC_011736.1 | NC_003451 | NC_023015 | NC_004161 |
| NC_017644.1 | NC_014218.1 | NC_011779.1 | NC_002520 | NC_019512 | NC_006934 |
| NZ_AGTD01000001.1 | NC_014365.1 | NC_011785.1 | NC_011559 | NC_019928 | NC_009988 |
| NC_017646.1 | NC_014391.1 | NC_011724.1 | NC_013036 | NC_019931 | NC_001617 |
| NC_017651.1 | NC_012704.1 | NC_011781.1 | NC_020470 | NC_016568 | NC_009996 |
| NC_017652.1 | NC_013062.1 | NC_017423.1 | NC_020471 | NC_013447 | NC_011103 |
| NC_017656.1 | NC_014844.1 | NC_017399.1 | NC_003468 | NC_005074 | NC_021560 |
| NC_017663.1 | NC_014831.1 | NC_017417.1 | NC_003467 | NC_005075 | NC_021557 |
| NC_017660.1 | NC_015172.1 | NC_017420.1 | NC_003466 | NC_024016 | NC_023566 |
| NC_017664.1 | NC_014655.1 | NC_017422.1 | NC_023876 | NC_011354 | NC_023502 |
| NC_017906.1 | NC_015702.1 | NC_017416.1 | NC_007733 | NC_015718 | NC_022619 |
| NZ_AKBV01000001.1 | NC_014221.1 | NC_017400.1 | NC_023421 | NC_010240 | NC_023684 |
| NC_017638.1 | NC_014829.1 | NC_017415.1 | NC_013668 | NC_011615 | NC_023685 |
| NZ_AKVX01000001.1 | NC_010572.1 | NC_017402.1 | NC_023426 | NC_003094 | NC_003801 |
| NC_011993.1 | NC_012806.1 | NC_013130.1 | NC_011317 | NC_002654 | NC_003802 |
| NC_018650.1 | NC_014836.1 | NC_017401.1 | NC_023848 | NC_001981 | NC_018613 |
| NC_018661.1 | NC_014664.1 | NC_017414.1 | NC_023683 | NC_001982 | NC_020839 |
| NC_020163.1 | NC_015291.1 | NC_017398.1 | NC_023682 | NC_004156 | NC_016165 |
| NC_020518.1 | NC_014640.1 | NC_017421.1 | NC_023483 | NC_003349 | NC_020489 |
| NC_022364.1 | NC_023061.1 | NC_017424.1 | NC_008035 | NC_009233 | NC_021347 |
| NC_022648.1 | NC_013203.1 | NC_017419.1 | NC_008520 | NC_012038 | NC_016655 |
| NC_002655.2 | NC_015656.1 | NC_017395.1 | NC_016447 | NC_005979 | NC_016652 |
| NC_011745.1 | NC_021031.1 | NC_017394.1 | NC_004365 | NC_005978 | NC_016654 |
| NZ_CM000960.1 | NC_021013.1 | NC_013129.1 | NC_014905 | NC_005981 | NC_016653 |
| NZ_CM000662.1 | NC_021041.1 | NC_017393.1 | NC_018504 | NC_005980 | NC_016650 |
| NC_000915.1 | NC_021039.1 | NC_017406.1 | NC_003676 | NC_003607 | NC_016651 |
| NC_000921.1 | NC_021019.1 | NC_017396.1 | NC_001409 | NC_022073 | NC_023706 |
| NC_017382.1 | NC_014041.1 | NC_017428.1 | NC_018714 | NC_021923 | NC_023735 |
| NC_008086.1 | NC_021021.1 | NC_017412.1 | NC_003787 | NC_001906 | NC_023722 |
| NC_010698.2 | NC_021027.1 | NC_017408.1 | NC_003788 | NC_001489 | NC_023694 |
| NC_011333.1 | NC_014774.1 | NC_017405.1 | NC_003480 | NC_003977 | NC_014481 |
| NC_011498.1 | NC_010321.1 | NC_017425.1 | NC_003464 | NC_004102 | NC_004735 |
| NC_017354.1 | NC_008752.1 | NC_017410.1 | NC_003465 | NC_009823 | NC_020866 |
| NC_012973.1 | NC_007626.1 | NC_017409.1 | NC_001749 | NC_009824 | NC_001874 |
| NC_017355.1 | NC_004578.1 | NC_017413.1 | NC_003462 | NC_009825 | NC_012482 |
| NC_017357.1 | NC_005773.3 | NC_017404.1 | NC_014821 | NC_009826 | NC_012481 |
| NC_014560.1 | NC_016603.1 | NC_017426.1 | NC_006946 | NC_009827 | NC_010293 |
| NC_014555.1 | NZ_CM001194.1 | NC_017411.1 | NC_023295 | NC_001434 | NC_010294 |
| NC_017358.1 | NC_021035.1 | NC_017427.1 | NC_007589 | NC_001655 | NC_015488 |
| NC_017359.1 | NC_014803.1 | NC_017407.1 | NC_007584 | NC_001653 | NC_015489 |
| NC_017360.1 | NC_014800.1 | NC_017397.1 | NC_007588 | NC_001486 | NC_014903 |
| NC_017372.1 | NC_012968.1 | NC_011847.1 | NC_007592 | NC_007518 | NC_014902 |
| NC_017371.1 | NC_015673.1 | NC_011843.1 | NC_007585 | NC_005281 | NC_002792 |
| NC_017362.1 | NC_014828.1 | NC_011872.1 | NC_007582 | NC_023485 | NC_003729 |
| NC_017361.1 | NC_014484.1 | NC_011874.1 | NC_007590 | NC_003608 | NC_003734 |
| NC_017374.1 | NC_017583.1 | NC_011868.1 | NC_007591 | NC_016142 | NC_003731 |
| NC_017381.1 | NC_014374.1 | NC_011876.1 | NC_007583 | NC_016141 | NC_003730 |
| NC_014256.1 | NC_013282.2 | NC_011853.1 | NC_005166 | NC_016143 | NC_003737 |
| NC_017375.1 | NC_014207.1 | NC_011864.1 | NC_005176 | NC_008310 | NC_003736 |
| NC_017378.1 | NC_015164.1 | NC_011845.1 | NC_005175 | NC_012561 | NC_003735 |
| NC_017379.1 | NC_015681.1 | NC_011850.1 | NC_005174 | NC_003782 | NC_003728 |
| NC_017376.1 | NC_015949.1 | NC_011866.1 | NC_005173 | NC_011540 | NC_003733 |
| NC_017063.1 | NC_014314.1 | NC_011865.1 | NC_005167 | NC_017967 | NC_003732 |
| NC_017733.1 | NC_014761.1 | NC_011846.1 | NC_005168 | NC_005093 | NC_003761 |
| NC_017926.1 | NC_014315.1 | NC_011862.1 | NC_005169 | NC_007914 | NC_003765 |
| NC_017368.1 | NC_014392.1 | NC_011851.1 | NC_005172 | NC_007918 | NC_003772 |
| NC_017365.1 | NC_022359.1 | NC_011863.1 | NC_005171 | NC_004071 | NC_003766 |
| NC_017366.1 | NC_022349.1 | NC_011849.1 | NC_005170 | NC_004092 | NC_003774 |
| NC_017367.1 | NC_016602.1 | NC_011841.1 | NC_006057 | NC_016649 | NC_003773 |
| NC_017739.1 | NC_016628.1 | NC_011870.1 | NC_006056 | NC_008029 | NC_003763 |
| NC_017740.1 | NC_015312.1 | NC_012506.1 | NC_003523 | NC_012544 | NC_003762 |
| NC_017741.1 | NC_015676.1 | NC_012518.1 | NC_001546 | NC_012535 | NC_003767 |
| NC_017742.1 | NC_014507.1 | NC_012504.1 | NC_018451 | NC_012543 | NC_003768 |
| NC_018939.1 | NC_015757.1 | NC_012494.1 | NC_020808 | NC_012542 | NC_003764 |
| NC_018937.1 | NC_016884.1 | NC_012512.1 | NC_008695 | NC_012545 | NC_003760 |
| NC_018938.1 | NZ_CM001167.1 | NC_012497.1 | NC_014609 | NC_012546 | NC_009248 |
| NC_019560.1 | NC_015660.1 | NC_012515.1 | NC_009026 | NC_012541 | NC_009245 |
| NC_019563.1 | NZ_CM001483.1 | NC_012496.1 | NC_018176 | NC_012536 | NC_009242 |

TABLE 4-continued

GenBank accession numbers of published prokaryote
chromosome and plasmid sequences, and virus sequences (including
entry version number ".N"; GenBank database release 202, 15 Jun. 2014)

| | | | | | |
|---|---|---|---|---|---|
| NC_020508.1 | NC_014652.1 | NC_012499.1 | NC_020898 | NC_012537 | NC_009252 |
| NC_020509.1 | NC_014657.1 | NC_012509.1 | NC_020897 | NC_012538 | NC_009244 |
| NC_021215.2 | NC_014136.1 | NC_012263.1 | NC_017914 | NC_012539 | NC_009243 |
| NC_021216.2 | NC_014250.1 | NC_012255.1 | NC_022972 | NC_012540 | NC_009249 |
| NC_021217.2 | NC_014329.1 | NC_012255.1 | NC_016752 | NC_014967 | NC_009247 |
| NC_021218.2 | NC_017301.1 | NC_012254.1 | NC_001339 | NC_009450 | NC_009250 |
| NC_021882.1 | NC_017300.1 | NC_012246.1 | NC_023634 | NC_008793 | NC_009251 |
| NC_022886.1 | NC_017303.1 | NC_012237.1 | NC_023633 | NC_009449 | NC_009241 |
| NC_022911.1 | NC_017305.1 | NC_012244.1 | NC_023635 | NC_005052 | NC_009246 |
| NC_022130.1 | NC_017306.1 | NC_012258.1 | NC_015523 | NC_009571 | NC_002327 |
| NC_016568.1 | NC_017307.1 | NC_012249.1 | NC_011808 | NC_003609 | NC_002326 |
| NC_002528.1 | NC_017308.1 | NC_012269.1 | NC_011809 | NC_005807 | NC_002328 |
| NC_004061.1 | NC_016781.1 | NC_012259.1 | NC_011807 | NC_002552 | NC_002325 |
| NC_004545.1 | NC_016932.1 | NC_012235.1 | NC_010416 | NC_010538 | NC_002324 |
| NC_011834.1 | NC_017031.1 | NC_012231.1 | NC_020102 | NC_021098 | NC_002323 |
| NC_011833.1 | NC_017462.1 | NC_012192.1 | NC_020103 | NC_021099 | NC_003757 |
| NC_008513.1 | NC_017730.1 | NC_012178.1 | NC_020101 | NC_005904 | NC_003769 |
| NZ_ACFK01000001.1 | NC_018019.1 | NC_012188.1 | NC_020100 | NC_005635 | NC_003758 |
| NC_017255.1 | NC_014152.1 | NC_012155.1 | NC_011400 | NC_005636 | NC_003770 |
| NC_017252.1 | NC_015968.1 | NC_012161.1 | NC_016155 | NC_002543 | NC_003752 |
| NC_017253.1 | NC_015275.1 | NC_012198.1 | NC_019028 | NC_018858 | NC_003759 |
| NC_017254.1 | NC_015707.1 | NC_012195.1 | NC_013060 | NC_011544 | NC_003771 |
| NC_015662.1 | NC_014934.1 | NC_012160.1 | NC_018669 | NC_001436 | NC_003751 |
| NC_017256.1 | NC_013520.1 | NC_012151.1 | NC_019026 | NC_001488 | NC_003750 |
| NC_017259.1 | NZ_CM002135.1 | NC_012148.1 | NC_019027 | NC_011800 | NC_003749 |
| NC_000922.1 | NC_014910.1 | NC_012153.1 | NC_016896 | NC_010810 | NC_003753 |
| NC_005043.1 | NC_015422.1 | NC_012187.1 | NC_019853 | NC_012959 | NC_003755 |
| NC_002491.1 | NC_015726.1 | NC_012150.1 | NC_001987 | NC_001460 | NC_003754 |
| NC_017285.1 | NC_015723.1 | NC_012175.1 | NC_003472 | NC_011203 | NC_003776 |
| NC_002179.2 | NC_008314.1 | NC_012171.1 | NC_003471 | NC_011202 | NC_001914 |
| NC_002180.1 | NC_008313.1 | NC_012189.1 | NC_003470 | NC_001405 | NC_001632 |
| NC_003112.2 | NC_009674.1 | NC_012159.1 | NC_024031 | NC_010956 | NC_001575 |
| NC_003116.1 | NC_014923.1 | NC_012167.1 | NC_007654 | NC_003266 | NC_003380 |
| NC_008767.1 | NC_006156.1 | NC_012162.1 | NC_003900 | NC_001454 | NC_003746 |
| NC_010120.1 | NC_007508.1 | NC_012197.1 | NC_007522 | NC_007455 | NC_019490 |
| NC_017501.1 | NC_013743.1 | NC_012262.1 | NC_003243 | NC_012042 | NC_014396 |
| NC_013016.1 | NZ_CM001022.1 | NC_012236.1 | NC_001623 | NC_012564 | NC_014397 |
| NC_017505.1 | NC_014253.1 | NC_012256.1 | NC_004828 | NC_012729 | NC_014395 |
| NC_017513.1 | NC_015161.1 | NC_012251.1 | NC_006263 | NC_002645 | NC_006296 |
| NC_017516.1 | NC_014933.1 | NC_012229.1 | NC_001402 | NC_006577 | NC_003675 |
| NC_017514.1 | NC_014738.1 | NC_012266.1 | NC_003990 | NC_005831 | NC_021153 |
| NC_017517.1 | NC_017569.1 | NC_012232.1 | NC_005947 | NC_005147 | NC_015049 |
| NC_017515.1 | NC_017045.1 | NC_012253.1 | NC_015396 | NC_023984 | NC_021154 |
| NC_017518.1 | NC_018609.1 | NC_012243.1 | NC_023425 | NC_012801 | NC_020415 |
| NC_017512.1 | NC_020125.1 | NC_012240.1 | NC_015116 | NC_012802 | NC_024070 |
| NC_002488.3 | NC_014734.1 | NC_012238.1 | NC_001408 | NC_012798 | NC_010348 |
| NC_004556.1 | NC_014724.1 | NC_012248.1 | NC_007652 | NC_023874 | NC_010347 |
| NC_010513.1 | NC_017470.1 | NC_012257.1 | NC_001866 | NC_021568 | NC_010346 |
| NC_010577.1 | NC_014376.1 | NC_012261.1 | NC_015126 | NC_022518 | NC_015298 |
| NC_017562.1 | NC_021047.1 | NC_012245.1 | NC_015135 | NC_012950 | NC_015299 |
| NC_002947.3 | NC_015722.1 | NC_012268.1 | NC_015134 | NC_004295 | NC_015300 |
| NC_009512.1 | NC_022238.1 | NC_012233.1 | NC_015133 | NC_015630 | NC_015301 |
| NC_010322.1 | NC_022236.1 | NC_012264.1 | NC_015132 | NC_001806 | NC_010806 |
| NC_010501.1 | NC_022245.1 | NC_012241.1 | NC_015130 | NC_001798 | NC_019031 |
| NC_017530.1 | NC_015520.1 | NC_011968.1 | NC_015129 | NC_001348 | NC_020999 |
| NC_015733.1 | NC_015958.1 | NC_011967.1 | NC_015128 | NC_007605 | NC_013462 |
| NC_017986.1 | NC_013893.1 | NC_012191.1 | NC_015127 | NC_009334 | NC_013463 |
| NC_018220.1 | NC_017353.1 | NC_011965.1 | NC_015131 | NC_006273 | NC_007537 |
| NC_019905.1 | NZ_CM001148.1 | NC_011972.1 | NC_019531 | NC_001664 | NC_007538 |
| NC_021491.1 | NC_013895.2 | NC_011966.1 | NC_003043 | NC_000898 | NC_020235 |
| NC_021505.1 | NC_014721.1 | NC_011970.1 | NC_006553 | NC_001716 | NC_020234 |
| NC_003485.1 | NC_015389.1 | NC_011974.1 | NC_023864 | NC_009333 | NC_016758 |
| NC_004070.1 | NC_016609.1 | NC_012186.1 | NC_010355 | NC_001802 | NC_016760 |
| NC_009332.1 | NC_013665.1 | NC_012201.1 | NC_001538 | NC_001722 | NC_016759 |
| NC_004606.1 | NC_015957.1 | NC_012193.1 | NC_015881 | NC_004148 | NC_016757 |
| NC_006086.1 | NC_014654.1 | NC_011975.1 | NC_015882 | NC_013035 | NC_021565 |
| NC_007296.1 | NC_022239.1 | NC_012172.1 | NC_015877 | NC_001576 | NC_015466 |
| NC_008021.1 | NC_022244.1 | NC_012511.1 | NC_015880 | NC_008189 | NC_002519 |
| NC_008022.1 | NC_013956.2 | NC_012517.1 | NC_015879 | NC_008188 | NC_001544 |
| NC_008023.1 | NC_017554.1 | NC_012508.1 | NC_015878 | NC_012213 | NC_005888 |
| NC_008024.1 | NC_017531.1 | NC_012502.1 | NC_015885 | NC_012485 | NC_011507 |
| NC_011375.1 | NC_016816.1 | NC_012498.1 | NC_015884 | NC_012486 | NC_011502 |
| NC_017596.1 | NC_010118.1 | NC_012514.1 | NC_015886 | NC_014185 | NC_011503 |
| NC_017040.1 | NC_013123.1 | NC_012495.1 | NC_015883 | NC_016157 | NC_011508 |
| NC_017053.1 | NC_014004.1 | NC_012507.1 | NC_009760 | NC_014469 | NC_011510 |
| NZ_AFRY01000001.1 | NC_014499.1 | NC_012513.1 | NC_011523 | NC_014952 | NC_011501 |

TABLE 4-continued

GenBank accession numbers of published prokaryote
chromosome and plasmid sequences, and virus sequences (including
entry version number ".N"; GenBank database release 202, 15 Jun. 2014)

| | | | | | |
|---|---|---|---|---|---|
| NC_018936.1 | NC_021916.1 | NC_012516.1 | NC_020478 | NC_014953 | NC_011509 |
| NC_020540.2 | NC_018025.1 | NC_012501.1 | NC_004165 | NC_014954 | NC_011500 |
| NC_021807.1 | NC_014762.1 | NC_012510.1 | NC_018863 | NC_014955 | NC_011506 |
| NC_003098.1 | NC_014958.1 | NC_012500.1 | NC_019515 | NC_014956 | NC_011505 |
| NC_003028.3 | NC_015160.1 | NC_012505.1 | NC_006557 | NC_017993 | NC_011504 |
| NC_008533.1 | NC_014318.1 | NC_012503.1 | NC_018860 | NC_017994 | NC_007570 |
| NC_012468.1 | NC_017186.1 | NC_012170.1 | NC_019912 | NC_017995 | NC_007573 |
| NC_012466.1 | NC_018266.1 | NC_012152.1 | NC_023501 | NC_017996 | NC_007572 |
| NC_012467.1 | NC_022116.1 | NC_012203.1 | NC_018857 | NC_017997 | NC_007574 |
| NC_012469.1 | NC_014562.1 | NC_012194.1 | NC_005258 | NC_021483 | NC_007546 |
| NC_010380.1 | NC_015978.1 | NC_012156.1 | NC_018856 | NC_001526 | NC_007543 |
| NC_011072.1 | NC_015636.1 | NC_012227.1 | NC_022769 | NC_019023 | NC_007544 |
| NC_010582.1 | NZ_CM000920.1 | NC_012157.1 | NC_022773 | NC_022892 | NC_007571 |
| NC_011900.1 | NZ_CM001403.1 | NC_012228.1 | NC_018085 | NC_023891 | NC_007545 |
| NC_014494.1 | NC_013798.1 | NC_012154.1 | NC_022761 | NC_022095 | NC_007547 |
| NC_014498.1 | NC_015215.1 | NC_012158.1 | NC_007457 | NC_001583 | NC_007569 |
| NC_018594.1 | NC_017576.1 | NC_012149.1 | NC_020479 | NC_001586 | NC_014514 |
| NC_014251.1 | NC_021009.1 | NC_012202.1 | NC_020477 | NC_001587 | NC_014511 |
| NC_017593.1 | NC_021030.1 | NC_012199.1 | NC_007814 | NC_001457 | NC_014520 |
| NC_017592.1 | NC_021038.1 | NC_012111.1 | NC_020480 | NC_001354 | NC_014521 |
| NC_017591.1 | NC_015977.1 | NC_012163.1 | NC_023719 | NC_001690 | NC_014512 |
| NC_021006.1 | NC_014408.1 | NC_012168.1 | NC_002649 | NC_001591 | NC_014513 |
| NC_021028.1 | NC_014830.1 | NC_012184.1 | NC_006945 | NC_001531 | NC_014515 |
| NC_021026.1 | NC_014225.1 | NC_012182.1 | NC_007458 | NC_001691 | NC_014516 |
| NC_021005.1 | NC_015672.1 | NC_012104.1 | NC_022766 | NC_001593 | NC_014517 |
| NC_017769.1 | NZ_CM001487.1 | NC_012106.1 | NC_022771 | NC_001693 | NC_014518 |
| NZ_AKVY01000001.1 | NC_021016.1 | NC_012196.1 | NC_011167 | NC_001458 | NC_014519 |
| NC_018630.1 | NC_014259.1 | NC_012113.1 | NC_021336 | NC_001355 | NC_021628 |
| NZ_CM001835.1 | NC_017506.1 | NC_012112.1 | NC_017976 | NC_001595 | NC_021627 |
| NC_022655.1 | NC_013939.1 | NC_012107.1 | NC_020883 | NC_010329 | NC_021633 |
| NC_011985.1 | NC_014974.1 | NC_012174.1 | NC_022764 | NC_001596 | NC_021635 |
| NC_011983.1 | NC_014355.1 | NC_012110.1 | NC_022770 | NC_004104 | NC_021632 |
| NZ_CM002025.1 | NC_015946.1 | NC_012179.1 | NC_022765 | NC_004500 | NC_021630 |
| NZ_CM002024.1 | NC_021083.1 | NC_012165.1 | NC_019487 | NC_005134 | NC_021631 |
| NC_020800.1 | NC_014914.1 | NC_012114.1 | NC_011421 | NC_003461 | NC_021626 |
| NZ_CM002268.1 | NC_018108.1 | NC_012105.1 | NC_004166 | NC_003443 | NC_021634 |
| NC_004342.2 | NC_015732.1 | NC_008381.1 | NC_001884 | NC_001796 | NC_021629 |
| NC_004343.2 | NC_018644.1 | NC_008383.1 | NC_022774 | NC_021928 | NC_021625 |
| NC_005824.1 | NC_015499.1 | NC_008378.1 | NC_022763 | NC_001897 | NC_021580 |
| NC_005823.1 | NC_014935.1 | NC_008384.1 | NC_022767 | NC_007018 | NC_021583 |
| NC_017552.1 | NC_014013.1 | NC_008382.1 | NC_011645 | NC_000883 | NC_021588 |
| NC_017551.1 | NC_014006.1 | NC_008379.1 | NC_022088 | NC_007027 | NC_021585 |
| NC_003454.1 | NC_015174.1 | NC_011371.1 | NC_016563 | NC_007026 | NC_021584 |
| NC_021281.1 | NC_016582.1 | NC_011366.1 | NC_007734 | NC_020890 | NC_021582 |
| NC_022196.1 | NC_015321.1 | NC_011368.1 | NC_022094 | NC_015150 | NC_021589 |
| NZ_CM000440.1 | NC_015589.1 | NC_011370.1 | NC_004820 | NC_001781 | NC_021581 |
| NC_003997.3 | NC_016631.1 | NC_012853.1 | NC_004821 | NC_001490 | NC_021587 |
| NC_005945.1 | NC_015152.1 | NC_012858.1 | NC_019502 | NC_021551 | NC_021586 |
| NC_007530.2 | NC_017384.1 | NC_012852.1 | NC_004167 | NC_021550 | NC_021590 |
| NC_012581.1 | NC_014625.1 | NC_012854.1 | NC_011048 | NC_021547 | NC_001407 |
| NC_012659.1 | NC_013204.1 | NC_012848.1 | NC_020081 | NC_021548 | NC_008298 |
| NC_017729.1 | NC_015436.1 | NC_009478.1 | NC_023599 | NC_021544 | NC_018871 |
| NZ_AAAC02000001.1 | NC_015318.1 | NC_009479.1 | NC_021856 | NC_021545 | NC_009021 |
| NC_004337.2 | NC_015510.1 | NC_010408.1 | NC_023007 | NC_021541 | NC_001545 |
| NC_004741.1 | NC_014330.1 | NC_010399.1 | NC_020873 | NC_021546 | NC_019025 |
| NC_008258.1 | NC_018607.1 | NC_010846.1 | NC_009737 | NC_021549 | NC_011920 |
| NC_017328.1 | NC_019908.1 | NC_010844.1 | NC_011551 | NC_021543 | NC_023895 |
| NZ_CM001474.1 | NC_018604.1 | NC_010604.1 | NC_016770 | NC_021542 | NC_001814 |
| NC_004307.2 | NC_015678.1 | NC_008385.1 | NC_011222 | NC_006066 | NC_003747 |
| NC_010816.1 | NC_017905.1 | NC_010553.1 | NC_012534 | NC_006064 | NC_004718 |
| NC_011593.1 | NC_014961.1 | NC_004671.1 | NC_001642 | NC_006065 | NC_018136 |
| NC_014169.1 | NC_014963.1 | NC_004670.1 | NC_003497 | NC_012869 | NC_018138 |
| NC_014656.1 | NC_017934.1 | NC_004669.1 | NC_023850 | NC_006943 | NC_018137 |
| NC_015067.1 | NC_015703.1 | NC_017313.1 | NC_009745 | NC_014322 | NC_020106 |
| NC_015052.1 | NC_018142.1 | NC_017314.1 | NC_003475 | NC_014321 | NC_006313 |
| NC_017221.1 | NC_015311.1 | NC_017315.1 | NC_003473 | NC_007767 | NC_006317 |
| NC_017219.1 | NC_015177.1 | NC_018223.1 | NC_003479 | NC_008970 | NC_002066 |
| NC_021008.1 | NC_014926.1 | NC_018222.1 | NC_003476 | NC_008987 | NC_004051 |
| NZ_CM002287.1 | NC_014297.1 | NZ_ASWX01000006.1 | NC_003474 | NC_008963 | NC_004050 |
| NC_008309.1 | NC_014758.1 | NC_016838.1 | NC_003477 | NC_008989 | NC_001782 |
| NC_010519.1 | NC_015588.1 | NC_016839.1 | NC_002729 | NC_008950 | NC_003745 |
| NC_007005.1 | NC_015556.1 | NC_016847.1 | NC_015506 | NC_008990 | NC_001641 |
| NZ_CM001763.1 | NC_015593.1 | NC_016841.1 | NC_007002 | NC_008991 | NC_013464 |
| NZ_CM001986.1 | NC_015594.1 | NC_016840.1 | NC_015507 | NC_008992 | NC_009448 |
| NC_004116.1 | NC_015859.1 | NC_016846.1 | NC_006955 | NC_008993 | NC_001780 |
| NC_007432.1 | NC_014909.2 | NC_009653.1 | NC_003381 | NC_009003 | NC_023496 |

TABLE 4-continued

GenBank accession numbers of published prokaryote
chromosome and plasmid sequences, and virus sequences (including
entry version number ".N"; GenBank database release 202, 15 Jun. 2014)

| | | | | | |
|---|---|---|---|---|---|
| NC_018646.1 | NC_015846.1 | NC_009650.1 | NC_015502 | NC_008997 | NC_014567 |
| NC_019048.1 | NC_015555.1 | NC_009651.1 | NC_015503 | NC_008998 | NC_001350 |
| NC_021485.1 | NC_015508.1 | NC_009652.1 | NC_015504 | NC_008946 | NC_016448 |
| NC_021507.1 | NC_015183.1 | NC_009649.1 | NC_015505 | NC_008973 | NC_020844 |
| NC_021486.1 | NC_015964.1 | NC_006625.1 | NC_007003 | NC_008996 | NC_019540 |
| NC_004368.1 | NC_015144.1 | NC_011281.1 | NC_008018 | NC_008954 | NC_017983 |
| NC_002516.2 | NC_016818.1 | NC_011282.1 | NC_010107 | NC_008980 | NC_012986 |
| NC_008463.1 | NC_017047.1 | NC_017541.1 | NC_010817 | NC_008948 | NC_012957 |
| NC_009656.1 | NC_015167.1 | NC_022078.1 | NC_004211 | NC_009001 | NC_003930 |
| NC_011770.1 | NC_015385.1 | NC_022083.1 | NC_004220 | NC_008981 | NC_015938 |
| NZ_AAQW01000001.1 | NC_015387.1 | NC_011367.1 | NC_004217 | NC_008982 | NC_021774 |
| NZ_AFXJ01000001.1 | NC_015278.1 | NC_010124.1 | NC_004218 | NC_008983 | NC_021779 |
| NZ_AFXK01000001.1 | NC_013162.1 | NC_010123.1 | NC_004219 | NC_008984 | NC_021775 |
| NC_017548.1 | NC_015185.1 | NC_007764.1 | NC_004221 | NC_009002 | NC_021772 |
| NC_018080.1 | NC_015320.1 | NC_007762.1 | NC_004202 | NC_008952 | NC_021782 |
| NC_017549.1 | NC_015501.1 | NC_007766.1 | NC_004203 | NC_008985 | NC_021780 |
| NC_020912.1 | NC_015565.1 | NC_004041.2 | NC_004204 | NC_008971 | NC_005282 |
| NC_021577.1 | NC_015562.1 | NC_007763.1 | NC_004198 | NC_008972 | NC_010391 |
| NC_022808.1 | NC_012587.1 | NC_007765.1 | NC_004200 | NC_008999 | NC_010463 |
| NC_022806.1 | NC_018000.1 | NC_010997.1 | NC_004201 | NC_008969 | NC_002730 |
| NC_023019.1 | NC_016812.1 | NC_010996.1 | NC_015399 | NC_008947 | NC_021777 |
| NC_023066.1 | NC_015633.1 | NC_010998.1 | NC_013459 | NC_008959 | NC_021317 |
| NC_023149.1 | NC_015637.1 | NC_021911.1 | NC_013458 | NC_008953 | NC_022772 |
| NZ_CP006705.1 | NC_022224.1 | NC_021908.1 | NC_011063 | NC_008957 | NC_022768 |
| NZ_CP006728.1 | NC_022223.1 | NC_021907.1 | NC_011064 | NC_008951 | NC_016071 |
| NZ_CP006831.1 | NC_013171.1 | NC_021906.1 | NC_003483 | NC_008967 | NC_019530 |
| NZ_CP006832.1 | NC_013511.1 | NC_021909.1 | NC_003482 | NC_008955 | NC_019488 |
| NZ_HG530068.1 | NC_014624.2 | NC_021910.1 | NC_003469 | NC_009000 | NC_020416 |
| NZ_CP006980.1 | NC_015945.1 | NC_010160.1 | NC_003478 | NC_008960 | NC_011802 |
| NZ_CP006981.1 | NZ_CM001158.1 | NZ_CM001018.1 | NC_003481 | NC_008968 | NC_016763 |
| NZ_CP006982.1 | NC_015559.1 | NZ_CM001019.1 | NC_021481 | NC_008958 | NC_022752 |
| NZ_CP006983.1 | NC_015573.1 | NZ_CM001016.1 | NC_004666 | NC_008949 | NC_009232 |
| NZ_CP006985.1 | NC_014924.1 | NZ_CM001017.1 | NC_003680 | NC_008964 | NC_022754 |
| NZ_CM001020.1 | NC_014532.1 | NZ_CM000914.1 | NC_002160 | NC_008956 | NC_016073 |
| NC_004459.3 | NC_015558.1 | NC_017725.1 | NC_004750 | NC_008961 | NC_019910 |
| NC_004460.2 | NZ_AEUT02000001.1 | NC_017804.1 | NC_002991 | NC_008962 | NC_019417 |
| NC_005139.1 | NC_015276.1 | NC_011842.1 | NC_002990 | NC_008966 | NC_016761 |
| NC_005140.1 | NZ_CM001475.1 | NC_011855.1 | NC_001786 | NC_008965 | NC_019545 |
| NC_014966.1 | NC_015581.1 | NC_011857.1 | NC_009741 | NC_008988 | NC_017985 |
| NC_014965.1 | NC_014366.1 | NC_011856.1 | NC_014468 | NC_008976 | NC_006940 |
| NZ_CM001800.1 | NC_016629.1 | NC_011859.1 | NC_015932 | NC_008977 | NC_018843 |
| NZ_CM001799.1 | NC_015954.1 | NC_011860.1 | NC_016895 | NC_008978 | NC_014900 |
| NC_006360.1 | NC_013501.1 | NC_011861.1 | NC_021206 | NC_008979 | NC_004313 |
| NC_007295.1 | NC_015966.1 | NC_011854.1 | NC_008315 | NC_008986 | NC_004348 |
| NC_007332.1 | NC_015875.1 | NC_011858.1 | NC_010437 | NC_008994 | NC_010495 |
| NC_017509.1 | NC_014550.1 | NC_011840.1 | NC_010436 | NC_008995 | NC_015271 |
| NC_021283.1 | NC_015388.1 | NC_011848.1 | NC_014470 | NC_001493 | NC_015296 |
| NC_021831.1 | NC_014720.1 | NC_011875.1 | NC_022103 | NC_018629 | NC_004775 |
| NC_012926.1 | NC_015735.1 | NC_011871.1 | NC_020881 | NC_009028 | NC_011976 |
| NC_009442.1 | NC_021057.1 | NC_011867.1 | NC_018382 | NC_003625 | NC_013059 |
| NC_009443.1 | NC_015500.1 | NC_011877.1 | NC_015940 | NC_003624 | NC_021783 |
| NC_017617.1 | NC_015572.1 | NC_011844.1 | NC_015941 | NC_003616 | NC_010807 |
| NC_012924.1 | NC_019897.1 | NC_011873.1 | NC_015934 | NC_011536 | NC_023856 |
| NC_012925.1 | NC_019960.1 | NC_011869.1 | NC_017936 | NC_023486 | NC_018275 |
| NC_017618.1 | NC_019968.1 | NC_015217.1 | NC_014765 | NC_023487 | NC_019539 |
| NC_015433.1 | NC_022546.1 | NC_017288.1 | NC_015721 | NC_023488 | NC_023608 |
| NC_017619.1 | NC_015666.1 | NC_018633.1 | NC_019525 | NC_023492 | NC_018279 |
| NC_017620.1 | NZ_CM001488.1 | NC_018636.1 | NC_002643 | NC_023493 | NC_006318 |
| NC_017621.1 | NC_021184.1 | NC_018638.1 | NC_001944 | NC_023489 | NC_006319 |
| NC_017950.1 | NC_019964.1 | NC_018640.1 | NC_003505 | NC_023490 | NC_006320 |
| NC_017622.1 | NC_014960.1 | NC_018635.1 | NC_003504 | NC_023491 | NC_015413 |
| NC_018526.1 | NC_018631.1 | NC_018639.1 | NC_019568 | NC_023495 | NC_015411 |
| NC_020526.1 | NC_014722.1 | NC_018634.1 | NC_019569 | NC_023494 | NC_015412 |
| NC_021213.1 | NC_013521.1 | NC_018637.1 | NC_022003 | NC_001932 | NC_015070 |
| NC_022516.1 | NC_013441.1 | NC_014797.1 | NC_022005 | NC_001933 | NC_015069 |
| NC_022665.1 | NC_013440.1 | NC_019392.1 | NC_004047 | NC_003093 | NC_006554 |
| NC_008639.1 | NC_013512.1 | NC_017189.1 | NC_003397 | NC_004730 | NC_006269 |
| NC_010831.1 | NC_013515.1 | NC_020273.1 | NC_001930 | NC_004729 | NC_010624 |
| NC_008711.1 | NC_013517.1 | NC_022531.1 | NC_001931 | NC_001451 | NC_004048 |
| NC_009085.1 | NC_013510.1 | NC_010935.1 | NC_004042 | NC_004178 | NC_018466 |
| NC_010611.1 | NC_013522.1 | NC_011034.1 | NC_004043 | NC_004179 | NC_018462 |
| NC_011595.1 | NC_013530.1 | NC_022243.1 | NC_001439 | NC_003781 | NC_018461 |
| NC_011586.1 | NC_013523.1 | NC_017510.1 | NC_001438 | NC_001652 | NC_003785 |
| NC_010410.1 | NC_013524.1 | NC_017963.1 | NC_003369 | NC_001915 | NC_003786 |
| NC_020547.1 | NC_013526.1 | NC_017961.1 | NC_018070 | NC_001916 | NC_018671 |
| NC_017847.1 | NC_013525.1 | NC_017962.1 | NC_018072 | NC_006501 | NC_003399 |

TABLE 4-continued

GenBank accession numbers of published prokaryote chromosome and plasmid sequences, and virus sequences (including entry version number ".N"; GenBank database release 202, 15 Jun. 2014)

| | | | | | |
|---|---|---|---|---|---|
| NC_017162.1 | NC_013595.1 | NC_017024.1 | NC_018071 | NC_006500 | NC_003400 |
| NC_017387.1 | NC_013730.1 | NC_017023.1 | NC_003496 | NC_006502 | NC_011659 |
| NC_017171.1 | NC_013729.1 | NC_017032.1 | NC_003495 | NC_006503 | NC_005819 |
| NC_018706.1 | NC_013739.1 | NC_020208.1 | NC_010560 | NC_006497 | NC_005818 |
| NC_021726.1 | NC_013757.1 | NC_021987.1 | NC_010561 | NC_006498 | NC_005817 |
| NC_021733.1 | NC_013943.1 | NC_021995.1 | NC_003493 | NC_006499 | NC_004714 |
| NC_021729.1 | NC_013946.1 | NC_021989.1 | NC_015487 | NC_006505 | NC_007415 |
| NC_023028.1 | NC_021081.1 | NC_021990.1 | NC_003492 | NC_003494 | NC_017915 |
| NC_010400.1 | NC_013947.1 | NC_021996.1 | NC_010255 | NC_004910 | NC_023893 |
| NC_004842.2 | NC_014148.1 | NC_021988.1 | NC_010256 | NC_004905 | NC_021706 |
| NC_012026.1 | NC_014150.1 | NC_018680.1 | NC_016962 | NC_004911 | NC_013116 |
| NC_022784.1 | NC_014151.1 | NC_019394.1 | NC_004452 | NC_004912 | NC_015939 |
| NC_022760.1 | NC_014158.1 | NC_021709.1 | NC_006460 | NC_004908 | NC_022896 |
| NC_006322.1 | NC_014165.1 | NC_021718.1 | NC_002766 | NC_004909 | NC_023598 |
| NC_006270.3 | NC_014210.1 | NC_021711.1 | NC_011557 | NC_004906 | NC_013015 |
| NC_021362.1 | NC_014211.1 | NC_013357.1 | NC_011556 | NC_004907 | NC_013014 |
| NC_006347.1 | NC_014212.1 | NC_013358.1 | NC_010417 | NC_007382 | NC_009657 |
| NC_003228.3 | NC_014729.1 | NC_013356.1 | NC_001412 | NC_007375 | NC_011537 |
| NC_016776.1 | NC_013172.1 | NC_017180.1 | NC_003491 | NC_007378 | NC_012094 |
| NC_007606.1 | NC_013093.1 | NC_017182.1 | NC_005304 | NC_007376 | NC_015212 |
| NC_002942.5 | NC_013170.1 | NC_017184.1 | NC_003515 | NC_007374 | NC_009891 |
| NC_006368.1 | NC_012669.1 | NC_017181.1 | NC_003514 | NC_007381 | NC_021482 |
| NC_006369.1 | NC_013037.1 | NC_017185.1 | NC_003516 | NC_007380 | NC_003215 |
| NC_009494.2 | NC_013165.1 | NC_017183.1 | NC_003517 | NC_007377 | NC_001552 |
| NC_014125.1 | NC_013174.1 | NC_015716.1 | NC_003513 | NC_007366 | NC_011349 |
| NC_016811.1 | NC_013159.1 | NC_015715.1 | NC_005210 | NC_007372 | NC_006995 |
| NC_017525.1 | NC_013169.1 | NC_018146.1 | NC_005209 | NC_007369 | NC_005238 |
| NC_017526.1 | NC_013131.1 | NC_018148.1 | NC_003694 | NC_007368 | NC_005236 |
| NC_018140.1 | NC_013202.1 | NC_018147.1 | NC_003693 | NC_007373 | NC_005237 |
| NC_018139.1 | NC_013216.1 | NC_022902.1 | NC_003503 | NC_007367 | NC_008719 |
| NC_020521.1 | NC_013061.1 | NC_022910.1 | NC_003506 | NC_007371 | NC_021563 |
| NC_021350.1 | NC_013132.1 | NC_022913.1 | NC_003507 | NC_007370 | NC_020083 |
| NC_007384.1 | NC_013223.1 | NC_022903.1 | NC_003508 | NC_002020 | NC_002568 |
| NC_016822.1 | NC_013158.1 | NC_022901.1 | NC_003518 | NC_002016 | NC_003795 |
| NC_006449.1 | NC_013166.1 | NC_013213.1 | NC_003520 | NC_002023 | NC_007433 |
| NC_006448.1 | NC_013192.1 | NC_013215.1 | NC_003519 | NC_002018 | NC_018464 |
| NC_008532.1 | NC_013124.1 | NC_013214.1 | NC_003512 | NC_002019 | NC_018467 |
| NC_017563.1 | NC_013173.1 | NC_013211.1 | NC_003511 | NC_002017 | NC_018463 |
| NC_017581.1 | NC_013235.1 | NC_013210.1 | NC_003510 | NC_002021 | NC_004002 |
| NC_017927.1 | NC_015518.1 | NC_013212.1 | NC_004045 | NC_002022 | NC_005890 |
| NC_006833.1 | NC_015663.1 | NC_017109.1 | NC_004756 | NC_007357 | NC_023594 |
| NC_006576.1 | NC_020181.1 | NC_017101.1 | NC_001598 | NC_007359 | NC_013693 |
| NC_007604.1 | NC_018017.1 | NC_017142.1 | NC_006956 | NC_007358 | NC_016566 |
| NC_009052.1 | NC_014810.2 | NC_017119.1 | NC_006957 | NC_007360 | NC_014595 |
| NC_009665.1 | NC_014925.1 | NC_017118.1 | NC_007803 | NC_007364 | NC_005344 |
| NC_011663.1 | NC_017568.1 | NC_017120.1 | NC_015781 | NC_007361 | NC_021857 |
| NC_009997.1 | NC_015942.1 | NC_017123.1 | NC_009642 | NC_007363 | NC_022749 |
| NC_017571.1 | NC_019903.1 | NC_017144.1 | NC_010646 | NC_007362 | NC_015456 |
| NC_016901.1 | NC_018068.1 | NC_017124.1 | NC_022643 | NC_002210 | NC_015457 |
| NC_017579.1 | NC_015683.1 | NC_017110.1 | NC_014143 | NC_002204 | NC_023589 |
| NZ_CM001435.1 | NC_017317.1 | NC_017143.1 | NC_012041 | NC_002211 | NC_021331 |
| NC_009438.1 | NC_018101.1 | NC_017122.1 | NC_011919 | NC_002206 | NC_003225 |
| NC_017566.1 | NC_014932.1 | NC_017129.1 | NC_014846 | NC_002205 | NC_018399 |
| NC_005295.2 | NC_015434.1 | NC_017145.1 | NC_014845 | NC_002209 | NC_023861 |
| NC_006831.1 | NC_015125.1 | NC_017127.1 | NC_003405 | NC_002207 | NC_014795 |
| NC_006832.1 | NC_015408.1 | NC_017128.1 | NC_014895 | NC_002208 | NC_014794 |
| NC_009513.1 | NC_022439.1 | NC_017117.1 | NC_003418 | NC_006309 | NC_004657 |
| NC_010609.1 | NC_022440.1 | NC_017126.1 | NC_018574 | NC_006310 | NC_004658 |
| NC_015697.1 | NC_022441.1 | NC_017133.1 | NC_023014 | NC_006307 | NC_014447 |
| NC_021494.1 | NZ_CM002309.1 | NC_017130.1 | NC_014325 | NC_006306 | NC_014446 |
| NC_021872.1 | NZ_CM002311.1 | NC_017132.1 | NC_007655 | NC_006311 | NC_004660 |
| NC_009848.1 | NC_015151.1 | NC_017147.1 | NC_001411 | NC_006308 | NC_004659 |
| NC_006461.1 | NC_015416.1 | NC_017148.1 | NC_002037 | NC_006312 | NC_002047 |
| NC_005835.1 | NC_015564.1 | NC_017131.1 | NC_023875 | NC_023615 | NC_002046 |
| NC_017272.1 | NZ_CM001484.1 | NC_017112.1 | NC_023305 | NC_008187 | NC_014130 |
| NC_017587.1 | NC_018014.1 | NC_017103.1 | NC_023300 | NC_023611 | NC_014128 |
| NC_003450.3 | NC_015259.1 | NC_017135.1 | NC_023304 | NC_003038 | NC_004635 |
| NC_009342.1 | NC_015186.1 | NC_017102.1 | NC_023302 | NC_021901 | NC_014799 |
| NC_020519.1 | NC_015424.1 | NC_017134.1 | NC_023301 | NC_023613 | NC_007638 |
| NC_021351.1 | NC_015690.1 | NC_017149.1 | NC_023299 | NC_011142 | NC_009557 |
| NC_021352.1 | NC_016935.1 | NC_017105.1 | NC_023307 | NC_001605 | NC_007640 |
| NC_022040.1 | NC_017672.3 | NC_017104.1 | NC_023306 | NC_016536 | NC_007639 |
| NC_006958.1 | NC_015315.1 | NC_017151.1 | NC_003784 | NC_013022 | NC_005330 |
| NC_000117.1 | NC_015376.1 | NC_017106.1 | NC_008182 | NC_007906 | NC_005331 |
| NC_010287.1 | NC_015381.1 | NC_017107.1 | NC_008183 | NC_007905 | NC_016573 |
| NC_007429.1 | NC_019904.1 | NC_017152.1 | NC_009890 | NC_018833 | NC_016579 |

TABLE 4-continued

GenBank accession numbers of published prokaryote
chromosome and plasmid sequences, and virus sequences (including
entry version number ".N"; GenBank database release 202, 15 Jun. 2014)

| | | | | | |
|---|---|---|---|---|---|
| NC_012687.1 | NC_015379.1 | NC_017115.1 | NC_011555 | NC_020809 | NC_015046 |
| NC_012686.1 | NC_015460.1 | NC_017137.1 | NC_011553 | NC_020806 | NC_015044 |
| NC_010280.2 | NC_015435.1 | NC_017136.1 | NC_011554 | NC_009025 | NC_015043 |
| NC_017434.1 | NZ_CM001377.1 | NC_017136.1 | NC_022072 | NC_007454 | NC_015047 |
| NC_017439.1 | NC_018643.1 | NC_017114.1 | NC_015706 | NC_001699 | NC_008056 |
| NC_017429.1 | NZ_CM001633.1 | NC_017113.1 | NC_008558 | NC_001494 | NC_008059 |
| NC_017430.1 | NC_017028.1 | NC_017035.1 | NC_006963 | NC_015123 | NC_020256 |
| NC_017440.1 | NC_016599.1 | NC_013200.1 | NC_006962 | NC_001437 | NC_004637 |
| NC_017431.1 | NC_015680.1 | NC_011223.1 | NC_003509 | NC_013134 | NC_020254 |
| NC_017432.1 | NZ_CM001195.1 | NC_011225.1 | NC_003502 | NC_013133 | NC_020255 |
| NC_017436.1 | NC_015516.1 | NC_010331.1 | NC_003872 | NC_002187 | NC_017987 |
| NZ_ABYD01000001.1 | NC_016938.1 | NC_011961.1 | NC_010837 | NC_000947 | NC_008779 |
| NZ_ABYE01000001.1 | NC_015635.1 | NC_010008.2 | NC_010638 | NC_011268 | NC_008780 |
| NZ_ABYF01000001.1 | NC_021921.1 | NC_014023.1 | NC_005041 | NC_019034 | NC_004639 |
| NZ_ABYG01000001.1 | NC_015866.1 | NC_004604.2 | NC_019036 | NC_024012 | NC_006267 |
| NZ_ACFJ01000001.1 | NC_015602.1 | NC_010009.2 | NC_019035 | NC_024013 | NC_016083 |
| NZ_ACUI01000001.1 | NC_015600.1 | NC_010010.2 | NC_005982 | NC_011309 | NC_016082 |
| NC_017441.1 | NC_015674.1 | NC_014025.1 | NC_005983 | NC_005287 | NC_020253 |
| NC_015744.1 | NC_017243.1 | NC_014031.1 | NC_019415 | NC_003606 | NC_023484 |
| NC_017437.1 | NC_015759.1 | NC_017139.1 | NC_014593 | NC_005080 | NC_009354 |
| NC_016798.1 | NC_015758.1 | NC_017140.1 | NC_016085 | NC_005081 | NC_009563 |
| NC_017952.1 | NC_015914.1 | NC_017141.1 | NC_016086 | NC_004284 | NC_009547 |
| NC_017951.1 | NC_015921.1 | NC_012723.1 | NC_016084 | NC_009238 | NC_009558 |
| NC_017953.1 | NC_015848.1 | NC_012718.1 | NC_016087 | NC_004205 | NC_014065 |
| NC_020966.1 | NC_019951.1 | NC_012720.2 | NC_003138 | NC_004213 | NC_004662 |
| NC_020944.1 | NC_019950.1 | NC_012725.2 | NC_003499 | NC_004209 | NC_004661 |
| NC_020971.1 | NC_019952.1 | NC_016837.1 | NC_022250 | NC_004215 | NC_007213 |
| NC_020970.1 | NC_019965.1 | NC_002679.1 | NC_022251 | NC_004210 | NC_008317 |
| NC_020940.1 | NC_018001.1 | NC_002682.1 | NC_022252 | NC_004206 | NC_008236 |
| NC_020937.1 | NC_018515.1 | NC_003078.1 | NC_018519 | NC_004207 | NC_008237 |
| NC_020929.1 | NC_017095.1 | NC_003037.1 | NC_018506 | NC_004199 | NC_012697 |
| NC_020973.1 | NC_016010.1 | NC_017324.1 | NC_006014 | NC_004212 | NC_018476 |
| NC_020930.1 | NZ_CM002261.1 | NC_017323.1 | NC_006022 | NC_004216 | NC_018477 |
| NC_020945.1 | NC_018513.1 | NC_015597.1 | NC_006025 | NC_004208 | NC_018478 |
| NC_020931.1 | NC_018514.1 | NC_015592.1 | NC_006024 | NC_004214 | NC_011546 |
| NC_020938.1 | NC_016052.1 | NC_017327.1 | NC_006010 | NC_005876 | NC_000858 |
| NC_020974.1 | NC_018081.1 | NC_017326.1 | NC_006013 | NC_013006 | NC_001815 |
| NC_021050.1 | NC_018016.1 | NC_016615.1 | NC_006015 | NC_004540 | NC_003323 |
| NC_021052.1 | NC_017068.1 | NC_018701.1 | NC_006023 | NC_023439 | NC_006879 |
| NC_021895.1 | NC_018750.1 | NC_018682.1 | NC_006007 | NC_005064 | NC_022266 |
| NC_021887.1 | NZ_CM001538.1 | NC_019846.1 | NC_006008 | NC_002232 | NC_020485 |
| NC_021888.1 | NC_017094.1 | NC_019847.1 | NC_023761 | NC_001541 | NC_006144 |
| NC_021896.1 | NC_022041.1 | NC_019849.1 | NC_023762 | NC_006947 | NC_015225 |
| NC_021889.1 | NC_018024.1 | NC_019848.1 | NC_014358 | NC_004807 | NC_021168 |
| NC_021897.1 | NC_017770.1 | NC_020527.1 | NC_012672 | NC_012533 | NC_001364 |
| NC_021890.1 | NC_016940.1 | NC_020560.1 | NC_015524 | NC_007619 | NC_003092 |
| NC_021891.1 | NC_019793.1 | NC_018830.1 | NC_006630 | NC_010435 | NC_001549 |
| NC_021898.1 | NC_016026.1 | NC_007641.1 | NC_020927 | NC_001746 | NC_004455 |
| NC_021892.1 | NC_020812.1 | NC_014825.1 | NC_020928 | NC_016159 | NC_014474 |
| NC_021899.1 | NC_016024.1 | NC_014827.1 | NC_004287 | NC_022343 | NC_004451 |
| NC_021893.1 | NC_016025.1 | NC_014824.1 | NC_001962 | NC_023567 | NC_007611 |
| NC_023060.1 | NC_016001.1 | NC_014826.1 | NC_004142 | NC_020204 | NC_001669 |
| NC_022117.1 | NC_019892.1 | NC_000959.1 | NC_004145 | NC_011043 | NC_006428 |
| NC_022118.1 | NC_016043.1 | NC_000958.1 | NC_003679 | NC_014036 | NC_005216 |
| NC_022107.1 | NC_016041.1 | NC_001988.2 | NC_005809 | NC_020080 | NC_005217 |
| NC_022119.1 | NC_020418.1 | NC_017296.1 | NC_005808 | NC_013647 | NC_005215 |
| NC_022121.1 | NC_021064.1 | NC_015686.1 | NC_005357 | NC_013649 | NC_001547 |
| NC_020939.1 | NC_018012.1 | NC_015688.1 | NC_001607 | NC_019781 | NC_006549 |
| NC_020967.1 | NC_012793.1 | NC_003383.1 | NC_007612 | NC_005857 | NC_008514 |
| NC_020943.1 | NC_013411.1 | NC_019958.1 | NC_010350 | NC_011534 | NC_003324 |
| NC_020968.1 | NC_014206.1 | NC_019959.1 | NC_010349 | NC_021704 | NC_016437 |
| NC_020969.1 | NC_014650.1 | NC_019957.1 | NC_010351 | NC_009029 | NC_003433 |
| NC_020942.1 | NC_014915.1 | NC_001732.1 | NC_009224 | NC_007913 | NC_014137 |
| NC_020964.1 | NC_020210.1 | NC_001733.1 | NC_011372 | NC_017714 | NC_007013 |
| NC_020941.1 | NC_022080.4 | NC_007349.1 | NC_017991 | NC_009645 | NC_007014 |
| NC_020965.1 | NZ_CM001904.1 | NC_007515.1 | NC_017990 | NC_009647 | NC_006148 |
| NC_020975.1 | NC_017860.1 | NC_004719.1 | NC_002604 | NC_003610 | NC_009989 |
| NC_020976.1 | NC_017861.1 | NC_008791.1 | NC_005132 | NC_004109 | NC_001724 |
| NC_020933.1 | NC_016610.1 | NC_015475.1 | NC_011592 | NC_004110 | NC_000903 |
| NC_020934.1 | NC_021182.1 | NC_017565.1 | NC_005889 | NC_004108 | NC_005950 |
| NC_020977.1 | NZ_HG810405.1 | NC_009426.1 | NC_022074 | NC_017843 | NC_013600 |
| NC_020978.1 | NC_016617.1 | NC_009427.1 | NC_001876 | NC_001639 | NC_007902 |
| NC_020936.1 | NC_020059.1 | NC_001880.1 | NC_002685 | NC_010179 | NC_002330 |
| NC_020935.1 | NC_009783.1 | NC_010630.1 | NC_023632 | NC_004112 | NC_002351 |
| NC_020932.1 | NC_009784.1 | NC_010633.1 | NC_023631 | NC_019916 | NC_002041 |
| NC_020972.1 | NC_022269.1 | NC_010629.1 | NC_023630 | NC_022756 | NC_002042 |

TABLE 4-continued

GenBank accession numbers of published prokaryote
chromosome and plasmid sequences, and virus sequences (including
entry version number ".N"; GenBank database release 202, 15 Jun. 2014)

| | | | | | |
|---|---|---|---|---|---|
| NC_020512.1 | NC_022270.1 | NC_010631.1 | NC_023629 | NC_019456 | NC_003850 |
| NC_020511.1 | NC_016639.1 | NC_010632.1 | NC_003045 | NC_007924 | NC_022748 |
| NC_022106.1 | NC_017065.1 | NC_010366.1 | NC_002526 | NC_019486 | NC_009544 |
| NC_022108.1 | NC_016077.1 | NC_010368.1 | NC_001831 | NC_009554 | NC_012531 |
| NC_022109.1 | NC_020156.1 | NC_010369.1 | NC_001847 | NC_022989 | NC_006559 |
| NC_022120.1 | NC_016148.1 | NC_010367.1 | NC_002665 | NC_006565 | NC_001615 |
| NC_022110.1 | NC_017910.1 | NC_004720.1 | NC_005261 | NC_012530 | NC_004015 |
| NC_000908.2 | NC_016616.1 | NC_002182.1 | NC_018668 | NC_007501 | NC_004014 |
| NC_018495.1 | NC_019695.1 | NC_003904.1 | NC_001413 | NC_011104 | NC_004035 |
| NC_018496.1 | NC_018645.1 | NC_003903.1 | NC_004421 | NC_011801 | NC_003804 |
| NC_018497.1 | NC_016050.1 | NC_007974.2 | NC_001414 | NC_022757 | NC_003803 |
| NC_018498.1 | NC_017941.1 | NC_007971.2 | NC_005337 | NC_019489 | NC_004060 |
| NC_008542.1 | NC_019778.1 | NC_007972.2 | NC_002161 | NC_019449 | NC_001625 |
| NC_008544.1 | NC_018011.1 | NC_003425.1 | NC_001540 | NC_019782 | NC_016960 |
| NC_008543.1 | NC_021885.1 | NC_006569.1 | NC_006259 | NC_005893 | NC_014714 |
| NC_011002.1 | NC_018612.1 | NC_004319.1 | NC_001442 | NC_022775 | NC_014716 |
| NC_011000.1 | NC_018690.1 | NC_004320.1 | NC_012948 | NC_006936 | NC_014717 |
| NC_011001.1 | NC_018704.1 | NC_008496.1 | NC_012949 | NC_022762 | NC_014713 |
| NC_008061.1 | NC_016885.1 | NC_016820.1 | NC_001989 | NC_000896 | NC_014708 |
| NC_008060.1 | NC_016605.1 | NC_016821.1 | NC_010354 | NC_004305 | NC_014715 |
| NC_008062.1 | NC_017096.1 | NC_016828.1 | NC_001461 | NC_005354 | NC_014709 |
| NC_010515.1 | NC_016048.1 | NC_016827.1 | NC_002032 | NC_005355 | NC_014712 |
| NC_010508.1 | NC_019771.1 | NC_016806.1 | NC_012812 | NC_010576 | NC_014710 |
| NC_010512.1 | NC_017790.1 | NC_004349.1 | NC_016038 | NC_021853 | NC_014711 |
| NC_006350.1 | NC_018013.1 | NC_006390.1 | NC_022039 | NC_008370 | NC_011591 |
| NC_006351.1 | NC_019978.1 | NC_006392.1 | NC_022038 | NC_015263 | NC_011187 |
| NC_007434.1 | NC_019974.1 | NC_006391.1 | NC_022037 | NC_002796 | NC_018505 |
| NC_007435.1 | NC_019973.1 | NC_006393.1 | NC_007447 | NC_021861 | NC_014142 |
| NC_009075.1 | NC_016633.1 | NC_006394.1 | NC_009530 | NC_009817 | NC_014141 |
| NC_009074.1 | NC_016622.1 | NC_006395.1 | NC_004008 | NC_008363 | NC_001739 |
| NC_009078.1 | NZ_CM002307.1 | NC_006389.1 | NC_004007 | NC_012663 | NC_018457 |
| NC_009076.1 | NC_018010.1 | NC_021871.1 | NC_004006 | NC_004746 | NC_018456 |
| NC_017832.1 | NC_017668.1 | NC_007900.1 | NC_004424 | NC_021852 | NC_003357 |
| NC_017831.1 | NC_020388.1 | NC_004703.1 | NC_004425 | NC_008364 | NC_003056 |
| NC_018527.1 | NC_019977.1 | NC_014035.1 | NC_004423 | NC_002747 | NC_014140 |
| NC_018529.1 | NC_018020.1 | NC_004565.1 | NC_022004 | NC_002703 | NC_002634 |
| NC_021877.1 | NZ_CM001402.1 | NC_015213.1 | NC_022006 | NC_010363 | NC_016033 |
| NC_021884.1 | NZ_CM001555.1 | NC_015218.1 | NC_005290 | NC_011046 | NC_011643 |
| NC_012695.1 | NC_017098.1 | NC_008012.1 | NC_005289 | NC_001909 | NC_016992 |
| NZ_CM000833.1 | NC_019962.1 | NC_008013.1 | NC_003003 | NC_002666 | NC_001963 |
| NZ_CM000832.1 | NC_018027.1 | NC_008014.1 | NC_003004 | NC_002667 | NC_001964 |
| NZ_CM000774.1 | NC_016604.1 | NC_020128.1 | NC_015253 | NC_002668 | NC_019521 |
| NZ_CM000775.1 | NC_016109.1 | NC_020129.1 | NC_015254 | NC_002669 | NC_009545 |
| NC_006349.2 | NC_019792.1 | NC_020130.1 | NC_015252 | NC_002670 | NC_015051 |
| NC_006348.1 | NC_018748.1 | NC_006375.1 | NC_002028 | NC_002671 | NC_003810 |
| NC_008784.1 | NZ_CM001441.1 | NC_006377.1 | NC_002027 | NC_001629 | NC_003809 |
| NC_008785.1 | NC_018719.1 | NC_006376.1 | NC_002026 | NC_001706 | NC_003808 |
| NC_008835.1 | NC_018691.1 | NC_014558.2 | NC_003501 | NC_008371 | NC_014631 |
| NC_008836.1 | NC_020291.1 | NC_021904.1 | NC_014822 | NC_021860 | NC_023023 |
| NC_009080.1 | NC_016894.1 | NC_021903.1 | NC_014243 | NC_021854 | NC_009987 |
| NC_009079.1 | NC_019940.1 | NC_021912.1 | NC_014242 | NC_021855 | NC_003793 |
| NC_007164.1 | NZ_CM001436.1 | NC_021227.1 | NC_014241 | NC_023574 | NC_001365 |
| NC_007799.1 | NZ_CM001437.1 | NC_021228.1 | NC_014244 | NC_005822 | NC_003438 |
| NC_007484.1 | NC_017464.1 | NC_021226.1 | NC_014240 | NC_004302 | NC_001270 |
| NC_005957.1 | NZ_CM001440.1 | NC_021225.1 | NC_014239 | NC_001835 | NC_016879 |
| NC_008600.1 | NZ_CM001439.1 | NC_021233.1 | NC_014238 | NC_004066 | NC_016878 |
| NC_014171.1 | NC_019943.1 | NC_021234.1 | NC_014237 | NC_023641 | NC_016874 |
| NC_017200.1 | NC_016111.1 | NC_021527.1 | NC_014236 | NC_020807 | NC_016880 |
| NC_017208.1 | NC_017586.1 | NC_021528.1 | NC_014245 | NC_001619 | NC_016875 |
| NC_018500.1 | NC_016584.1 | NC_021517.1 | NC_019447 | NC_010737 | NC_016881 |
| NC_018508.1 | NZ_CM001514.1 | NC_021518.1 | NC_019446 | NC_023017 | NC_016876 |
| NC_018693.1 | NC_023150.2 | NC_021520.1 | NC_010944 | NC_023016 | NC_016882 |
| NC_018877.1 | NC_016510.2 | NC_021516.1 | NC_020105 | NC_003690 | NC_016877 |
| NC_020238.1 | NZ_CM001398.1 | NC_021519.1 | NC_014536 | NC_023627 | NC_016883 |
| NC_020376.1 | NC_016147.2 | NC_021515.1 | NC_004764 | NC_004296 | NC_014359 |
| NC_022873.1 | NC_018649.1 | NC_021525.1 | NC_014373 | NC_004297 | NC_001500 |
| NZ_CM000746.1 | NC_018673.1 | NC_021526.1 | NC_001925 | NC_010760 | NC_016405 |
| NZ_CM000747.1 | NC_019791.1 | NC_008499.1 | NC_001926 | NC_010758 | NC_023676 |
| NZ_CM000748.1 | NC_022878.1 | NC_008498.1 | NC_001927 | NC_015326 | NC_002169 |
| NZ_CM000749.1 | NC_021900.1 | NC_020825.1 | NC_021736 | NC_001822 | NC_008361 |
| NZ_CM000750.1 | NC_020892.1 | NC_020828.1 | NC_021735 | NC_004011 | NC_009011 |
| NZ_CM000751.1 | NC_016627.1 | NC_020827.1 | NC_018283 | NC_002063 | NC_009503 |
| NZ_CM000752.1 | NC_016078.1 | NC_020824.1 | NC_005263 | NC_003601 | NC_003102 |
| NZ_CM000753.1 | NC_017034.1 | NC_020823.1 | NC_007497 | NC_002064 | NC_011616 |
| NZ_CM000754.1 | NC_018665.1 | NC_020826.1 | NC_005262 | NC_011568 | NC_018577 |
| NZ_CM000755.1 | NC_019425.2 | NC_020820.1 | NC_005342 | NC_011558 | NC_018578 |

TABLE 4-continued

GenBank accession numbers of published prokaryote
chromosome and plasmid sequences, and virus sequences (including
entry version number ".N"; GenBank database release 202, 15 Jun. 2014)

| | | | | | |
|---|---|---|---|---|---|
| NZ_CM000756.1 | NC_017909.1 | NC_020822.1 | NC_004333 | NC_012909 | NC_004122 |
| NZ_CM000757.1 | NC_023029.1 | NC_020821.1 | NC_005886 | NC_012910 | NC_004120 |
| NZ_CM000758.1 | NC_016070.1 | NC_020212.1 | NC_005887 | NC_003617 | NC_004121 |
| NZ_CM000759.1 | NZ_CM001371.1 | NC_010549.1 | NC_009015 | NC_003618 | NC_002803 |
| NZ_CM001804.1 | NZ_CM001373.1 | NC_010550.1 | NC_009447 | NC_003605 | NC_011132 |
| NC_003295.1 | NC_018876.1 | NC_009806.1 | NC_012743 | NC_018104 | NC_023846 |
| NC_017574.1 | NC_023135.1 | NC_009660.1 | NC_019917 | NC_007642 | NC_023847 |
| NC_014311.1 | NC_016930.1 | NC_014120.1 | NC_005882 | NC_006054 | NC_007338 |
| NC_014307.1 | NC_017044.1 | NC_016591.1 | NC_009604 | NC_006053 | NC_007339 |
| NC_020799.1 | NC_017058.1 | NC_016592.1 | NC_005091 | NC_006052 | NC_005845 |
| NC_017559.1 | NC_017042.1 | NC_016626.1 | NC_018452 | NC_006051 | NC_005846 |
| NZ_CM002755.1 | NC_017043.1 | NC_017923.1 | NC_022916 | NC_010832 | NC_004651 |
| NZ_CM002757.1 | NC_020301.1 | NC_021295.1 | NC_018278 | NC_011532 | NC_001936 |
| NC_007205.1 | NZ_CM001557.1 | NC_021289.1 | NC_015266 | NC_008348 | NC_001937 |
| NC_007613.1 | NC_020300.1 | NC_009227.1 | NC_011216 | NC_013424 | NC_004645 |
| NC_010658.1 | NC_018264.1 | NC_009230.1 | NC_015273 | NC_018273 | NC_004646 |
| NC_008611.1 | NC_017992.1 | NC_009229.1 | NC_015265 | NC_020880 | NC_003799 |
| NC_002505.1 | NC_017527.1 | NC_009226.1 | NC_013055 | NC_020870 | NC_003800 |
| NC_002506.1 | NC_017956.1 | NC_009228.1 | NC_021343 | NC_007741 | NC_010521 |
| NC_009457.1 | NC_016638.1 | NC_008826.1 | NC_005284 | NC_007743 | NC_003865 |
| NC_009456.1 | NC_016906.1 | NC_021086.1 | NC_007145 | NC_007747 | NC_003860 |
| NC_012580.1 | NC_018868.3 | NC_007170.1 | NC_009235 | NC_007746 | NC_009951 |
| NC_012578.1 | NC_023075.1 | NC_007169.1 | NC_009236 | NC_007745 | NC_001514 |
| NC_012582.1 | NC_023076.1 | NC_007171.1 | NC_003309 | NC_007742 | NC_022563 |
| NC_012583.1 | NC_016887.1 | NC_022348.1 | NC_009234 | NC_007737 | NC_003861 |
| NC_012668.1 | NC_018664.1 | NC_022355.1 | NC_009237 | NC_007744 | NC_003862 |
| NC_012667.1 | NC_017964.1 | NC_022656.1 | NC_023813 | NC_007740 | NC_006003 |
| NC_016445.1 | NC_018870.1 | NC_012040.1 | NC_023815 | NC_007736 | NC_006004 |
| NC_016446.1 | NC_016641.1 | NC_013966.1 | NC_023816 | NC_007739 | NC_006006 |
| NC_017269.1 | NC_015873.1 | NC_013965.1 | NC_023819 | NC_007738 | NC_006005 |
| NC_017270.1 | NC_016749.1 | NC_013964.1 | NC_023814 | NC_019549 | NC_005997 |
| NC_016944.1 | NC_020135.1 | NC_013968.1 | NC_023818 | NC_019550 | NC_006002 |
| NC_016945.1 | NC_018681.1 | NC_012439.1 | NC_023820 | NC_010305 | NC_006001 |
| NZ_AKGH01000002.1 | NC_018267.1 | NC_015710.1 | NC_023822 | NC_005288 | NC_006000 |
| NZ_AKGH01000001.1 | NC_022084.1 | NC_013973.1 | NC_023817 | NC_005138 | NC_005998 |
| NZ_CM001786.1 | NC_017075.1 | NC_013972.1 | NC_023821 | NC_007192 | NC_005999 |
| NZ_CM001785.1 | NC_017030.1 | NC_013957.1 | NC_023008 | NC_009550 | NC_005099 |
| NC_015760.1 | NC_017079.1 | NC_023056.1 | NC_013527 | NC_009561 | NC_007580 |
| NC_017595.1 | NC_016593.1 | NC_023072.1 | NC_023442 | NC_007983 | NC_004091 |
| NC_018285.1 | NC_019386.1 | NC_023071.1 | NC_018484 | NC_003291 | NC_004615 |
| NC_017594.1 | NC_018002.1 | NC_023055.1 | NC_018481 | NC_009815 | NC_007047 |
| NC_005296.1 | NZ_CM001486.1 | NZ_AFHN01000023.1 | NC_003887 | NC_003216 | NC_007051 |
| NC_007778.1 | NC_017033.1 | NC_018999.1 | NC_003866 | NC_009810 | NC_007061 |
| NC_007958.1 | NC_018065.1 | NC_020919.1 | NC_001574 | NC_009811 | NC_007055 |
| NC_007925.1 | NZ_CM001490.1 | NC_020914.1 | NC_011803 | NC_009812 | NC_007053 |
| NC_008435.1 | NZ_CM001559.1 | NC_020915.1 | NC_002815 | NC_009813 | NC_007052 |
| NC_011004.1 | NC_018018.1 | NC_020920.1 | NC_014637 | NC_021539 | NC_004678 |
| NC_014834.1 | NZ_CM001438.1 | NC_020916.1 | NC_018572 | NC_021787 | NC_007054 |
| NC_007493.2 | NZ_AFRZ01000001.1 | NC_020918.1 | NC_021926 | NC_021785 | NC_007062 |
| NC_007494.2 | NC_022576.1 | NC_020921.1 | NC_006875 | NC_021781 | NC_007049 |
| NC_009049.1 | NZ_CM001466.1 | NC_020917.1 | NC_012699 | NC_009814 | NC_007060 |
| NC_009050.1 | NZ_CM001775.1 | NC_019100.1 | NC_004064 | NC_011308 | NC_007046 |
| NC_009428.1 | NZ_CM001467.1 | NC_010555.1 | NC_013796 | NC_018831 | NC_007048 |
| NC_011963.1 | NC_017080.1 | NC_021501.1 | NC_021196 | NC_020871 | NC_007059 |
| NC_011958.1 | NC_018720.1 | NC_018107.1 | NC_004367 | NC_006953 | NC_005356 |
| NZ_CM001162.1 | NC_016943.1 | NC_009794.1 | NC_003391 | NC_001836 | NC_009526 |
| NZ_CM001161.1 | NC_013260.1 | NC_009793.1 | NC_015267 | NC_005065 | NC_007050 |
| NZ_AKVW01000001.1 | NC_022786.1 | NC_009779.1 | NC_015268 | NC_003976 | NC_007063 |
| NZ_AKVW01000002.1 | NC_017059.1 | NC_009780.1 | NC_008002 | NC_016144 | NC_007064 |
| NZ_AKBU01000002.1 | NC_021591.1 | NC_020263.1 | NC_008007 | NC_020853 | NC_007057 |
| NZ_AKBU01000001.1 | NC_015567.1 | NC_020261.1 | NC_007993 | NC_010434 | NC_008722 |
| NC_010634.1 | NC_021659.1 | NC_020262.1 | NC_007994 | NC_021242 | NC_007056 |
| NC_006155.1 | NC_017808.1 | NC_023024.1 | NC_007996 | NC_021243 | NC_007066 |
| NC_009708.1 | NC_021252.1 | NC_023025.1 | NC_008006 | NC_021244 | NC_019448 |
| NC_010465.1 | NC_018290.1 | NC_011061.1 | NC_007998 | NC_001809 | NC_023550 |
| NC_006570.2 | NC_018507.1 | NC_006139.1 | NC_007999 | NC_004713 | NC_019726 |
| NC_008601.1 | NC_018140.1 | NC_007985 | NC_008000 | NC_001696 | NC_021773 |
| NC_007880.1 | NC_018676.1 | NC_009929.1 | NC_008000 | NC_003798 | NC_005880 |
| NC_008245.1 | NC_018677.1 | NC_009926.1 | NC_008001 | NC_009568 | NC_004679 |
| NC_008369.1 | NC_020831.1 | NC_009927.1 | NC_008003 | NC_010569 | NC_013195 |
| NC_009257.1 | NC_017461.1 | NC_009928.1 | NC_007992 | NC_007210 | NC_008723 |
| NC_009749.1 | NC_017735.1 | NC_009930.1 | NC_008005 | NC_007212 | NC_007045 |
| NC_010677.1 | NC_017737.1 | NC_009931.1 | NC_007997 | NC_008031 | NC_002321 |
| NC_017453.1 | NC_007519.1 | NC_009933.1 | NC_007995 | NC_007459 | NC_007058 |
| NC_019551.1 | NC_020304.1 | NC_009934.1 | NC_007990 | NC_004824 | NC_016565 |
| NC_017450.1 | NC_017093.1 | NC_009932.1 | NC_008004 | NC_004825 | NC_022920 |

TABLE 4-continued

GenBank accession numbers of published prokaryote
chromosome and plasmid sequences, and virus sequences (including
entry version number ".N"; GenBank database release 202, 15 Jun. 2014)

| | | | | | |
|---|---|---|---|---|---|
| NC_017449.1 | NC_019395.1 | NC_006363.1 | NC_007991 | NC_012777 | NC_022918 |
| NC_016933.1 | NC_019675.1 | NC_006362.1 | NC_007988 | NC_012776 | NC_019511 |
| NC_016937.1 | NC_019780.1 | NC_005871.1 | NC_008008 | NC_003027 | NC_021801 |
| NC_019537.1 | NC_019693.1 | NC_012782.1 | NC_007987 | NC_016153 | NC_021863 |
| NC_009497.1 | NC_019757.1 | NC_012780.1 | NC_007989 | NC_016152 | NC_009875 |
| NC_013948.1 | NC_019753.1 | NC_012030.1 | NC_007986 | NC_018710 | NC_014460 |
| NC_008054.1 | NC_019748.1 | NC_008738.1 | NC_019507 | NC_018711 | NC_019513 |
| NC_008529.1 | NC_019670.1 | NC_008739.1 | NC_018861 | NC_014898 | NC_023009 |
| NC_014727.1 | NC_022738.1 | NC_006824.1 | NC_016562 | NC_001973 | NC_018277 |
| NC_017469.1 | NC_023064.1 | NC_006823.1 | NC_015464 | NC_013953 | NC_020490 |
| NC_008508.1 | NC_008044.1 | NC_007930.1 | NC_003410 | NC_005902 | NC_019915 |
| NC_008509.1 | NC_015953.1 | NC_006530.1 | NC_017085 | NC_001824 | NC_019914 |
| NC_008510.1 | NC_021055.1 | NC_006529.1 | NC_005309 | NC_004294 | NC_021326 |
| NC_008511.1 | NZ_CM001165.1 | NC_017480.1 | NC_015375 | NC_004291 | NC_021323 |
| NC_006933.1 | NZ_CM002271.1 | NC_017479.1 | NC_015374 | NC_018102 | NC_021332 |
| NC_006932.1 | NZ_CM002273.1 | NC_017499.1 | NC_015373 | NC_015691 | NC_023499 |
| NC_010742.1 | NC_005966.1 | NZ_AICL01000008.1 | NC_001734 | NC_019851 | NC_023500 |
| NC_010740.1 | NC_007777.1 | NC_006673.1 | NC_020499 | NC_004812 | NC_017968 |
| NC_007624.1 | NC_009921.1 | NC_006674.1 | NC_004542 | NC_006150 | NC_007021 |
| NC_007618.1 | NC_014666.1 | NC_006675.1 | NC_020904 | NC_006146 | NC_007065 |
| NC_016795.1 | NZ_CM001489.1 | NC_006676.1 | NC_001921 | NC_003401 | NC_022758 |
| NC_016777.1 | NC_015222.1 | NC_006672.1 | NC_004442 | NC_010819 | NC_004616 |
| NC_007633.1 | NC_015731.1 | NC_019397.1 | NC_016075 | NC_005079 | NC_004617 |
| NZ_CM001150.1 | NC_002607.1 | NC_011981.1 | NC_019852 | NC_005078 | NC_011344 |
| NC_008783.1 | NC_021171.1 | NC_011982.1 | NC_008297 | NC_018570 | NC_019921 |
| NC_003919.1 | NC_017743.1 | NC_011991.1 | NC_010226 | NC_005094 | NC_020199 |
| NC_020815.1 | NC_018224.1 | NC_011984.1 | NC_016074 | NC_005095 | NC_003288 |
| NC_008599.1 | NC_019683.1 | NC_011986.1 | NC_001539 | NC_010952 | NC_008798 |
| NZ_CM001228.1 | NC_020561.1 | NC_014108.1 | NC_021178 | NC_010953 | NC_008799 |
| NC_006834.1 | NC_015737.1 | NC_014107.1 | NC_016964 | NC_004097 | NC_010147 |
| NC_007705.1 | NC_016791.1 | NC_016515.1 | NC_023852 | NC_004098 | NC_010808 |
| NC_010717.1 | NZ_CM001240.1 | NC_008608.1 | NC_006564 | NC_004099 | NC_004740 |
| NC_017267.1 | NC_007513.1 | NC_008607.1 | NC_013237 | NC_004100 | NC_008583 |
| NC_013853.1 | NC_007516.1 | NC_014170.1 | NC_016014 | NC_010647 | NC_008617 |
| NC_007712.1 | NC_007775.1 | NC_008759.1 | NC_013261 | NC_010648 | NC_012784 |
| NC_009380.1 | NC_008319.1 | NC_008764.1 | NC_008032 | NC_017002 | NC_008689 |
| NC_011978.1 | NC_010475.1 | NC_008758.1 | NC_022007 | NC_017001 | NC_022914 |
| NC_009089.1 | NC_009481.1 | NC_008761.1 | NC_022020 | NC_016999 | NC_023573 |
| NC_013315.1 | NC_009482.1 | NC_008757.1 | NC_011051 | NC_017000 | NC_002661 |
| NC_017178.1 | NC_005070.1 | NC_008760.1 | NC_001463 | NC_023812 | NC_011612 |
| NC_017177.1 | NC_007776.1 | NC_008762.1 | NC_023422 | NC_014462 | NC_011614 |
| NC_017179.1 | NC_019680.1 | NC_008763.1 | NC_008303 | NC_014465 | NC_009761 |
| NC_013316.1 | NC_019702.1 | NC_013719.1 | NC_008302 | NC_014463 | NC_009762 |
| NC_017175.1 | NZ_CM001776.1 | NC_013718.1 | NC_008301 | NC_014464 | NC_009763 |
| NC_013974.1 | NC_015474.1 | NC_013717.1 | NC_001600 | NC_023041 | NC_022090 |
| NZ_CM000441.1 | NC_017946.1 | NC_009939.1 | NC_022919 | NC_023043 | NC_020877 |
| NZ_CM000287.1 | NC_017445.1 | NC_008010.2 | NC_020067 | NC_023039 | NC_023582 |
| NZ_CM000637.1 | NZ_CM002177.1 | NC_007961.1 | NC_010297 | NC_023040 | NC_018281 |
| NZ_CM000661.1 | NC_009436.1 | NC_007959.1 | NC_011530 | NC_023042 | NC_018284 |
| NZ_CM000657.1 | NC_021500.1 | NC_007960.1 | NC_003500 | NC_006367 | NC_002486 |
| NZ_CM000658.1 | NC_015061.1 | NC_007720.1 | NC_003498 | NC_010246 | NC_008033 |
| NZ_CM000604.1 | NC_003272.1 | NC_007719.1 | NC_001265 | NC_016993 | NC_011050 |
| NZ_CM000659.1 | NC_019676.1 | NC_007717.1 | NC_003531 | NC_011542 | NC_019416 |
| NZ_CM000660.1 | NC_019684.1 | NC_007718.1 | NC_003530 | NC_003626 | NC_011589 |
| NC_008209.1 | NC_008541.1 | NC_010180.1 | NC_022978 | NC_003627 | NC_023588 |
| NC_007347.1 | NC_018531.1 | NC_010181.1 | NC_023162 | NC_003377 | NC_015586 |
| NC_007348.1 | NC_017278.1 | NC_010183.1 | NC_001726 | NC_005974 | NC_021569 |
| NC_007907.1 | NC_008322.1 | NC_010182.1 | NC_011515 | NC_005975 | NC_007189 |
| NC_011830.1 | NC_008321.1 | NC_008269.1 | NC_003871 | NC_007729 | NC_008366 |
| NC_009348.1 | NC_008750.1 | NC_008270.1 | NC_006265 | NC_002786 | NC_006965 |
| NC_008528.1 | NC_008577.1 | NC_008271.1 | NC_013007 | NC_017917 | NC_006964 |
| NC_002971.3 | NC_015865.1 | NC_007111.1 | NC_004288 | NC_001346 | NC_003848 |
| NC_009727.1 | NC_016051.1 | NC_007110.1 | NC_023844 | NC_003631 | NC_003794 |
| NC_010117.1 | NC_018015.1 | NC_008036.1 | NC_012698 | NC_009533 | NC_003445 |
| NC_011527.1 | NC_009485.1 | NC_007901.1 | NC_001658 | NC_021484 | NC_003446 |
| NC_011528.1 | NC_009445.1 | NC_007617.1 | NC_018628 | NC_008730 | NC_008708 |
| NC_008526.1 | NC_007082.1 | NC_007615.1 | NC_017004 | NC_008737 | NC_008707 |
| NC_014334.1 | NZ_CM001442.1 | NC_007616.1 | NC_017005 | NC_008731 | NC_008706 |
| NC_010999.1 | NC_015566.1 | NC_008341.1 | NC_001648 | NC_008729 | NC_005896 |
| NC_017474.1 | NC_017573.1 | NC_008342.1 | NC_013112 | NC_008733 | NC_005895 |
| NC_017473.1 | NC_022582.1 | NC_007968.1 | NC_013111 | NC_008728 | NC_001725 |
| NC_018641.1 | NC_022584.1 | NC_007351.1 | NC_013113 | NC_008732 | NC_008365 |
| NC_021721.1 | NZ_CM002128.1 | NC_007352.1 | NC_007001 | NC_008734 | NC_023503 |
| NC_009953.1 | NZ_CM002130.1 | NC_012795.1 | NC_006999 | NC_008735 | NC_007019 |
| NC_002937.3 | NZ_CM002131.1 | NC_012797.1 | NC_007000 | NC_008736 | NC_012753 |
| NC_008751.1 | NZ_CM002132.1 | NC_010394.1 | NC_023178 | NC_010328 | NC_002185 |

TABLE 4-continued

GenBank accession numbers of published prokaryote chromosome and plasmid sequences, and virus sequences (including entry version number ".N"; GenBank database release 202, 15 Jun. 2014)

| | | | | | |
|---|---|---|---|---|---|
| NC_011769.1 | NZ_CM002133.1 | NC_021279.1 | NC_023986 | NC_008251 | NC_010353 |
| NC_017310.1 | NZ_CM002134.1 | NC_021278.1 | NC_001497 | NC_023896 | NC_013598 |
| NC_010002.1 | NC_000911.1 | NZ_ATFQ01000044.1 | NC_019406 | NC_008316 | NC_013645 |
| NC_007940.1 | NC_017277.1 | NC_009717.1 | NC_019410 | NC_021929 | NC_004814 |
| NC_009883.1 | NC_017038.1 | NC_010529.1 | NC_019407 | NC_021245 | NC_001825 |
| NZ_CM000487.1 | NC_017052.1 | NC_007427.1 | NC_019408 | NC_007711 | NC_002072 |
| NC_000964.3 | NC_017039.1 | NC_007428.1 | NC_019411 | NC_007724 | NC_015274 |
| NC_014479.1 | NC_020286.1 | NC_009469.1 | NC_019453 | NC_007725 | NC_005294 |
| NC_014976.1 | NC_007948.1 | NC_009474.1 | NC_019405 | NC_014907 | NC_012884 |
| NC_016047.1 | NC_010320.1 | NC_009467.1 | NC_015668 | NC_008561 | NC_003050 |
| NC_017195.1 | NC_014538.1 | NC_009468.1 | NC_020231 | NC_008559 | NC_004303 |
| NC_018520.1 | NC_008702.1 | NC_009471.1 | NC_019854 | NC_008560 | NC_009819 |
| NC_019896.1 | NC_020516.1 | NC_009472.1 | NC_018280 | NC_012665 | NC_012756 |
| NC_020244.1 | NC_009663.1 | NC_009470.1 | NC_015393 | NC_014647 | NC_010945 |
| NC_020507.1 | NC_008146.1 | NC_009473.1 | NC_001564 | NC_006631 | NC_004996 |
| NC_020832.1 | NC_008705.1 | NC_014628.1 | NC_021802 | NC_006632 | NC_008721 |
| NC_022898.1 | NC_009077.1 | NC_017543.1 | NC_021791 | NC_004733 | NC_021868 |
| NZ_CM000489.1 | NC_015576.1 | NC_010466.1 | NC_021797 | NC_004634 | NC_002214 |
| NZ_CM000490.1 | NC_017904.1 | NC_010470.1 | NC_021805 | NC_001943 | NC_000871 |
| NZ_CM000488.1 | NC_014837.1 | NC_010469.1 | NC_021803 | NC_004579 | NC_000872 |
| NC_005791.1 | NC_021023.1 | NC_010467.1 | NC_021806 | NC_002469 | NC_022776 |
| NC_009135.1 | NZ_CM002129.1 | NC_014544.1 | NC_021795 | NC_023681 | NC_020197 |
| NC_009637.1 | NC_021355.1 | NC_007678.1 | NC_021798 | NC_003529 | NC_018285 |
| NC_009975.1 | NC_019682.1 | NC_014026.1 | NC_021790 | NC_004117 | NC_009018 |
| NC_015847.1 | NC_019751.1 | NC_014157.1 | NC_021794 | NC_013229 | NC_022791 |
| NC_010678.1 | NC_017192.1 | NC_014030.1 | NC_021799 | NC_004277 | NC_019418 |
| NC_010682.1 | NC_022124.1 | NC_014028.1 | NC_021789 | NC_013231 | NC_004584 |
| NC_012856.1 | NC_015580.1 | NC_009620.1 | NC_021796 | NC_004281 | NC_004585 |
| NC_012857.1 | NC_019701.1 | NC_009621.1 | NC_021804 | NC_013230 | NC_004586 |
| NC_022513.1 | NC_019703.1 | NC_009622.1 | NC_021800 | NC_013227 | NC_004587 |
| NC_022514.1 | NC_019427.1 | NC_008696.1 | NC_021792 | NC_004278 | NC_004588 |
| NC_022515.1 | NC_019439.1 | NC_009973.1 | NC_021793 | NC_013228 | NC_004589 |
| NC_010080.1 | NC_019689.1 | NC_009974.1 | NC_021788 | NC_004280 | NC_018853 |
| NC_018528.1 | NC_019745.1 | NC_012529.1 | NC_020860 | NC_013225 | NC_021298 |
| NC_017467.1 | NC_019738.1 | NC_012528.1 | NC_020842 | NC_004279 | NC_019414 |
| NC_021744.1 | NC_010511.1 | NC_012527.1 | NC_016998 | NC_004276 | NC_018848 |
| NC_010263.2 | NC_015913.1 | NC_019938.1 | NC_010705 | NC_004275 | NC_021304 |
| NC_009882.1 | NC_016012.1 | NC_019937.1 | NC_010706 | NC_004274 | NC_005345 |
| NC_016908.1 | NC_017294.1 | NC_019939.1 | NC_010755 | NC_013234 | NC_021339 |
| NC_016909.1 | NC_003063.2 | NC_009796.1 | NC_010754 | NC_004283 | NC_007967 |
| NC_016914.1 | NC_003062.2 | NC_009795.1 | NC_006560 | NC_013226 | NC_004664 |
| NC_016915.1 | NC_020813.1 | NC_008213.1 | NC_012783 | NC_004282 | NC_001978 |
| NC_016913.1 | NC_008254.1 | NC_017460.1 | NC_002686 | NC_013233 | NC_018836 |
| NC_016911.1 | NC_007802.1 | NC_017457.1 | NC_002198 | NC_013232 | NC_014229 |
| NC_018887.1 | NC_008699.1 | NC_017458.1 | NC_004751 | NC_008201 | NC_012754 |
| NC_017238.1 | NZ_CM001852.1 | NC_008771.1 | NC_003533 | NC_021778 | NC_012755 |
| NC_008277.1 | NC_020830.1 | NC_008230.1 | NC_004324 | NC_009489 | NC_003449 |
| NC_021042.1 | NC_020802.1 | NC_009508.1 | NC_020065 | NC_008716 | NC_003448 |
| NC_021020.1 | NC_018268.1 | NC_009507.1 | NC_015211 | NC_001608 | NC_003525 |
| NC_008618.1 | NC_009654.1 | NC_010627.1 | NC_007193 | NC_009757 | NC_004914 |
| NC_014820.1 | NC_014472.1 | NC_010625.1 | NC_012212 | NC_009758 | NC_011357 |
| NC_009142.1 | NC_008782.1 | NC_009955.1 | NC_023441 | NC_009756 | NC_008464 |
| NC_004603.1 | NC_018708.1 | NC_009956.1 | NC_014748 | NC_008019 | NC_018571 |
| NC_004605.1 | NC_009524.1 | NC_009959.1 | NC_005883 | NC_008026 | NC_004346 |
| NC_019971.1 | NC_021661.1 | NC_009958.1 | NC_020805 | NC_022790 | NC_003851 |
| NC_019955.1 | NC_009523.1 | NC_009957.1 | NC_022633 | NC_018269 | NC_003814 |
| NC_021821.1 | NC_012918.1 | NC_010815.1 | NC_022638 | NC_013756 | NC_003818 |
| NC_021847.1 | NC_014973.1 | NC_009829.1 | NC_022640 | NC_008725 | NC_003813 |
| NC_021848.1 | NC_010338.1 | NC_010679.1 | NC_022639 | NC_001550 | NC_003817 |
| NC_021822.1 | NC_009659.1 | NC_011249.1 | NC_022635 | NC_008519 | NC_003819 |
| NC_010172.1 | NC_009675.1 | NC_011259.1 | NC_022641 | NC_015230 | NC_003816 |
| NC_011757.1 | NC_011145.1 | NC_011226.1 | NC_022634 | NC_003417 | NC_003815 |
| NC_012808.1 | NC_010730.1 | NC_011265.1 | NC_022636 | NC_001498 | NC_003812 |
| NC_012988.1 | NC_011126.1 | NC_011264.1 | NC_022637 | NC_016072 | NC_006432 |
| NC_015930.1 | NC_020411.1 | NC_011251.1 | NC_022642 | NC_020232 | NC_003031 |
| NC_017490.1 | NC_020814.1 | NC_011245.1 | NC_017086 | NC_023640 | NC_008017 |
| NC_012588.1 | NC_010547.1 | NC_011248.1 | NC_010562 | NC_020444 | NC_013455 |
| NC_012589.1 | NC_010546.1 | NC_011262.1 | NC_010563 | NC_020446 | NC_003398 |
| NC_012632.1 | NC_011726.1 | NC_011250.1 | NC_002588 | NC_020445 | NC_001868 |
| NC_012726.1 | NC_011729.1 | NC_011256.1 | NC_004618 | NC_020448 | NC_023989 |
| NC_012622.1 | NC_011884.1 | NC_011261.1 | NC_001946 | NC_020443 | NC_004755 |
| NC_012623.1 | NC_013161.1 | NC_011254.1 | NC_015414 | NC_020442 | NC_014037 |
| NC_017276.1 | NC_014501.1 | NC_011257.1 | NC_015415 | NC_020441 | NC_003744 |
| NC_017275.1 | NC_009662.1 | NC_011247.1 | NC_002500 | NC_020440 | NC_003870 |
| NZ_AHJK01000001.1 | NC_015391.1 | NC_011224.1 | NC_002468 | NC_020447 | NC_024072 |
| NZ_AHJO01000001.1 | NC_022606.1 | NC_011258.1 | NC_006271 | NC_020439 | NC_000874 |

TABLE 4-continued

GenBank accession numbers of published prokaryote chromosome and plasmid sequences, and virus sequences (including entry version number ".N"; GenBank database release 202, 15 Jun. 2014)

| | | | | | |
|---|---|---|---|---|---|
| NZ_AHJQ01000001.1 | NC_015380.1 | NC_011263.1 | NC_006272 | NC_013266 | NC_006151 |
| NZ_AHJR01000001.1 | NC_016642.1 | NC_011260.1 | NC_020996 | NC_013267 | NC_012696 |
| NZ_AHJT01000001.1 | NC_010483.1 | NC_011246.1 | NC_003689 | NC_013268 | NC_020858 |
| NC_021058.1 | NC_021014.1 | NC_011252.1 | NC_001427 | NC_001993 | NC_020862 |
| NC_013769.1 | NC_011662.2 | NC_011253.1 | NC_003790 | NC_002641 | NC_020856 |
| NC_010505.1 | NC_015497.1 | NC_011255.1 | NC_023857 | NC_010809 | NC_020882 |
| NC_009488.1 | NC_012914.1 | NC_012634.1 | NC_022131 | NC_014380 | NC_019413 |
| NC_010793.1 | NC_013406.1 | NC_009897.1 | NC_014740 | NC_014381 | NC_003214 |
| NC_010610.1 | NC_012032.1 | NC_016939.1 | NC_011058 | NC_014379 | NC_004087 |
| NC_017465.1 | NC_012673.1 | NC_009329.1 | NC_008249 | NC_001504 | NC_004086 |
| NC_021235.1 | NC_022794.1 | NC_010371.1 | NC_014739 | NC_008306 | NC_023585 |
| NC_009706.1 | NC_013889.1 | NC_016748.1 | NC_003778 | NC_008307 | NC_001338 |
| NC_011837.1 | NC_013454.1 | NC_015729.1 | NC_003971 | NC_008300 | NC_005265 |
| NC_002950.2 | NC_013418.2 | NC_015741.1 | NC_004162 | NC_007620 | NC_009986 |
| NC_010729.1 | NC_016146.1 | NC_015728.1 | NC_021345 | NC_020900 | NC_011217 |
| NC_015571.1 | NC_016621.1 | NC_015471.1 | NC_013103 | NC_023763 | NC_013587 |
| NZ_CM001843.1 | NC_017924.1 | NC_010727.1 | NC_005048 | NC_023764 | NC_013588 |
| NC_008571.1 | NC_020195.1 | NC_010721.1 | NC_004628 | NC_010277 | NC_005892 |
| NC_002162.1 | NC_020510.1 | NC_010381.1 | NC_016044 | NC_015490 | NC_014099 |
| NC_010503.1 | NC_022550.1 | NC_012169.1 | NC_005778 | NC_015491 | NC_005361 |
| NC_011374.1 | NC_013854.1 | NC_012180.1 | NC_014127 | NC_007965 | NC_005360 |
| NC_005364.2 | NC_012416.1 | NC_012129.1 | NC_017825 | NC_007966 | NC_006268 |
| NC_021025.1 | NC_014815.1 | NC_012177.1 | NC_023677 | NC_022647 | NC_020077 |
| NC_015431.1 | NZ_CM001368.1 | NC_012128.1 | NC_014743 | NC_010818 | NC_014038 |
| NC_007651.1 | NC_013887.1 | NC_012166.1 | NC_002359 | NC_009088 | NC_019499 |
| NC_007650.1 | NC_015738.1 | NC_012133.1 | NC_002356 | NC_009903 | NC_021065 |
| NC_021173.1 | NC_019779.1 | NC_012131.1 | NC_018455 | NC_018573 | NC_013019 |
| NC_021174.1 | NZ_CM001230.1 | NC_012130.1 | NC_003830 | NC_001902 | NC_011280 |
| NZ_CM000438.1 | NC_021018.1 | NC_012185.1 | NC_003831 | NC_002628 | NC_003806 |
| NZ_CM000439.1 | NC_015563.1 | NC_012204.1 | NC_001741 | NC_009603 | NC_003807 |
| NC_018286.1 | NC_015554.1 | NC_011143.1 | NC_002194 | NC_023859 | NC_018448 |
| NC_023137.1 | NC_023044.1 | NC_011881.1 | NC_008355 | NC_008562 | NC_015328 |
| NC_020911.1 | NC_015064.1 | NC_011879.1 | NC_007461 | NC_008176 | NC_006550 |
| NC_006840.2 | NC_015277.1 | NC_009713.1 | NC_002180 | NC_008179 | NC_004124 |
| NC_006841.2 | NC_014733.1 | NC_015146.1 | NC_001466 | NC_008178 | NC_004123 |
| NC_011186.1 | NC_018485.1 | NC_015147.1 | NC_016444 | NC_008177 | NC_001841 |
| NC_011184.1 | NC_015638.1 | NC_010724.1 | NC_016443 | NC_008175 | NC_015324 |
| NZ_CM001400.1 | NC_019768.1 | NC_010715.1 | NC_021248 | NC_008174 | NC_020896 |
| NZ_CM001401.1 | NC_015458.1 | NC_012003.1 | NC_005137 | NC_008173 | NC_013640 |
| NC_009698.1 | NC_015976.1 | NC_011995.1 | NC_004778 | NC_008172 | NC_013465 |
| NC_009495.1 | NC_015696.1 | NC_011997.1 | NC_023177 | NC_008181 | NC_021719 |
| NC_009697.1 | NC_015757.1 | NC_012000.1 | NC_021925 | NC_008180 | NC_022586 |
| NC_009699.1 | NC_015734.1 | NC_011998.1 | NC_008168 | NC_008171 | NC_004640 |
| NC_010516.1 | NC_016745.1 | NC_011996.1 | NC_021924 | NC_020864 | NC_013467 |
| NC_010520.1 | NC_016002.1 | NC_012001.1 | NC_021249 | NC_014767 | NC_022232 |
| NC_010674.1 | NC_019942.1 | NC_012002.1 | NC_010712 | NC_008582 | NC_015317 |
| NC_010723.1 | NC_016645.1 | NC_011355.1 | NC_010711 | NC_007033 | NC_011052 |
| NC_012658.1 | NC_017803.1 | NC_011889.1 | NC_009087 | NC_007034 | NC_014968 |
| NC_012563.1 | NC_021191.1 | NC_011892.1 | NC_007151 | NC_007039 | NC_004650 |
| NC_017297.1 | NC_023035.1 | NC_011888.1 | NC_007587 | NC_007038 | NC_022231 |
| NC_015425.1 | NC_022545.1 | NC_011893.1 | NC_007586 | NC_007044 | NC_003797 |
| NC_017299.1 | NC_022535.1 | NC_011895.1 | NC_023420 | NC_007040 | NC_015228 |
| NC_010084.1 | NC_018867.1 | NC_011887.1 | NC_023888 | NC_007037 | NC_017970 |
| NC_010087.1 | NC_018866.1 | NC_011890.1 | NC_013020 | NC_007036 | NC_014742 |
| NC_010086.1 | NC_018697.1 | NC_010693.1 | NC_013028 | NC_007041 | NC_018093 |
| NC_010805.1 | NC_017845.1 | NC_010699.1 | NC_013029 | NC_007035 | NC_015655 |
| NC_010804.1 | NZ_CM001772.1 | NC_010697.1 | NC_013023 | NC_007032 | NC_012728 |
| NC_010801.1 | NC_018178.1 | NC_010696.1 | NC_013024 | NC_007030 | NC_003389 |
| NC_009667.1 | NC_018419.1 | NC_010695.1 | NC_013025 | NC_007031 | NC_015522 |
| NC_009668.1 | NC_018420.1 | NC_010580.1 | NC_013026 | NC_007029 | NC_020836 |
| NC_000963.1 | NC_021663.1 | NC_010578.1 | NC_013027 | NC_007028 | NC_003390 |
| NC_017560.1 | NC_020302.1 | NC_012109.1 | NC_013030 | NC_015785 | NC_020837 |
| NC_017049.1 | NC_023010.1 | NC_011801.1 | NC_013018 | NC_019843 | NC_021530 |
| NC_017050.1 | NC_018524.1 | NC_007487.1 | NC_014360 | NC_012702 | NC_016164 |
| NC_017056.1 | NC_022357.1 | NC_007486.1 | NC_023576 | NC_011189 | NC_015463 |
| NC_017048.1 | NC_020888.1 | NC_012552.1 | NC_023548 | NC_011190 | NC_015465 |
| NC_017057.1 | NZ_CM002139.1 | NC_013505.1 | NC_018151 | NC_003638 | NC_016766 |
| NC_020992.1 | NC_022792.1 | NC_007412.1 | NC_023153 | NC_003647 | NC_015569 |
| NC_020993.1 | NC_022795.1 | NC_007411.1 | NC_003877 | NC_003639 | NC_021536 |
| NC_017051.1 | NZ_CM001841.1 | NC_007410.1 | NC_003547 | NC_003640 | NC_023584 |
| NC_001318.1 | NZ_CM001838.1 | NC_013386.1 | NC_003548 | NC_003645 | NC_019444 |
| NC_011728.1 | NZ_CM001840.1 | NC_008688.1 | NC_003546 | NC_003644 | NC_023587 |
| NC_017418.1 | NZ_CM001857.1 | NC_006509.1 | NC_008170 | NC_003643 | NC_006820 |
| NC_017403.1 | NZ_CM001839.1 | NZ_ASTI01000039.1 | NC_008169 | NC_003648 | NC_020859 |
| NC_022048.1 | NZ_CM001842.1 | NC_023147.1 | NC_006316 | NC_003646 | NC_020486 |
| NC_000919.1 | NZ_CM001860.1 | NC_017557.1 | NC_006315 | NC_003642 | NC_020867 |

TABLE 4-continued

GenBank accession numbers of published prokaryote chromosome and plasmid sequences, and virus sequences (including entry version number ".N"; GenBank database release 202, 15 Jun. 2014)

| | | | | | |
|---|---|---|---|---|---|
| NC_010741.1 | NC_021915.1 | NC_017555.1 | NC_006314 | NC_023626 | NC_020838 |
| NC_017268.1 | NC_018672.1 | NC_017556.1 | NC_006950 | NC_003641 | NC_013085 |
| NC_016842.1 | NC_018695.1 | NC_014812.1 | NC_001661 | NC_023639 | NC_020851 |
| NC_016848.1 | NC_018656.1 | NC_014811.1 | NC_009538 | NC_009546 | NC_015282 |
| NC_016843.1 | NC_020514.1 | NC_013509.1 | NC_009537 | NC_009556 | NC_015279 |
| NC_016844.1 | NZ_CM001792.1 | NC_017318.1 | NC_009536 | NC_009564 | NC_020875 |
| NC_018722.1 | NC_020504.1 | NC_012176.1 | NC_021564 | NC_010438 | NC_015289 |
| NC_021179.1 | NC_021237.1 | NC_012190.1 | NC_003382 | NC_020069 | NC_015287 |
| NC_021490.2 | NC_020908.1 | NC_012183.1 | NC_008293 | NC_019712 | NC_015281 |
| NC_021508.1 | NC_021499.1 | NC_012200.1 | NC_002657 | NC_023885 | NC_015286 |
| NC_008380.1 | NC_020054.1 | NC_012173.1 | NC_013698 | NC_023760 | NC_009531 |
| NC_011369.1 | NC_022657.1 | NC_012164.1 | NC_023549 | NC_006944 | NC_019443 |
| NC_012850.1 | NC_021985.1 | NC_012181.1 | NC_015397 | NC_006948 | NC_008296 |
| NC_007760.1 | NC_019902.1 | NC_012132.1 | NC_016572 | NC_001510 | NC_015227 |
| NC_011891.1 | NC_020134.1 | NC_015685.1 | NC_016578 | NC_016080 | NC_020498 |
| NC_009480.1 | NC_020887.2 | NC_015689.1 | NC_014646 | NC_004036 | NC_011024 |
| NC_010407.1 | NC_020515.1 | NC_017536.1 | NC_010714 | NC_004781 | NC_007735 |
| NC_020891.1 | NC_019566.1 | NC_017539.1 | NC_010713 | NC_004779 | NC_004293 |
| NC_014222.1 | NC_011883.1 | NC_013793.1 | NC_009451 | NC_004780 | NC_004292 |
| NC_010842.1 | NC_023036.1 | NC_013792.1 | NC_011347 | NC_004782 | NC_014372 |
| NC_010845.1 | NC_019697.1 | NC_015421.1 | NC_011346 | NC_003379 | NC_022745 |
| NC_010602.1 | NC_019729.1 | NC_015420.1 | NC_017003 | NC_007903 | NC_003996 |
| NC_010843.1 | NC_019776.1 | NC_015429.1 | NC_016519 | NC_007904 | NC_010702 |
| NC_010103.1 | NC_019949.1 | NC_016035.1 | NC_015398 | NC_022628 | NC_010701 |
| NC_010104.1 | NC_018611.1 | NC_016034.1 | NC_022646 | NC_022621 | NC_016003 |
| NC_016796.1 | NC_015519.1 | NC_011562.1 | NC_017978 | NC_022627 | NC_009888 |
| NC_016778.1 | NC_019954.2 | NC_011564.1 | NC_007581 | NC_022620 | NC_024071 |
| NC_010612.1 | NC_019907.1 | NC_011561.1 | NC_019523 | NC_022625 | NC_004450 |
| NC_008390.1 | NC_021741.1 | NC_011563.1 | NC_003524 | NC_022622 | NC_006942 |
| NC_008392.1 | NC_021066.1 | NC_013962.1 | NC_019924 | NC_022626 | NC_008291 |
| NC_008391.1 | NC_020055.1 | NZ_AKYF01000029.1 | NC_009231 | NC_022623 | NC_003005 |
| NC_010551.1 | NC_021846.1 | NC_014389.1 | NC_007917 | NC_022629 | NC_009742 |
| NC_010552.1 | NC_021833.1 | NC_014390.1 | NC_011398 | NC_022624 | NC_015843 |
| NC_010557.1 | NC_021280.1 | NC_012037.1 | NC_015568 | NC_003635 | NC_003157 |
| NC_004311.2 | NC_021284.1 | NC_012036.1 | NC_015262 | NC_006429 | NC_020869 |
| NC_004310.3 | NC_022998.1 | NC_013190.1 | NC_019506 | NC_001731 | NC_020840 |
| NC_010169.1 | NC_020075.1 | NC_013193.1 | NC_019496 | NC_001501 | NC_020861 |
| NC_010167.1 | NC_020126.1 | NC_013191.1 | NC_019508 | NC_001502 | NC_019930 |
| NC_017251.1 | NC_020506.1 | NC_013206.1 | NC_011318 | NC_003310 | NC_009990 |
| NC_017250.1 | NC_022444.1 | NC_013208.1 | NC_017980 | NC_004119 | NC_001366 |
| NC_016797.1 | NC_022737.1 | NC_013207.1 | NC_018083 | NC_006573 | NC_018264 |
| NC_016775.1 | NC_022793.1 | NC_012521.1 | NC_014457 | NC_006572 | NC_016899 |
| NC_004668.1 | NC_020209.1 | NC_006969.2 | NC_019421 | NC_006575 | NC_006556 |
| NC_017316.1 | NC_022097.1 | NC_012523.1 | NC_019422 | NC_006574 | NC_004462 |
| NC_017312.1 | NC_022079.1 | NC_012520.1 | NC_008265 | NC_016013 | NC_009803 |
| NC_017732.1 | NC_020829.1 | NC_006970.2 | NC_018084 | NC_011085 | NC_013197 |
| NC_018221.1 | NC_021715.1 | NC_012961.1 | NC_021325 | NC_020073 | NC_009804 |
| NC_019770.1 | NC_020409.1 | NC_013925.1 | NC_001753 | NC_009995 | NC_015937 |
| NC_013714.1 | NC_020453.1 | NC_013923.1 | NC_003536 | NC_013057 | NC_021784 |
| NC_017249.1 | NC_021177.1 | NC_013924.1 | NC_011108 | NC_013058 | NC_008584 |
| NC_016845.1 | NC_020546.1 | NC_011316.1 | NC_002618 | NC_023987 | NC_003973 |
| NC_009648.1 | NC_020520.1 | NC_011315.1 | NC_003742 | NC_015115 | NC_012585 |
| NC_012731.1 | NC_021169.1 | NC_011311.1 | NC_001465 | NC_021069 | NC_021705 |
| NC_011283.1 | NC_021175.1 | NC_011314.1 | NC_009764 | NC_005339 | NC_006495 |
| NC_017540.1 | NC_021917.1 | NC_014249.1 | NC_015692 | NC_015935 | NC_006506 |
| NC_018522.1 | NC_021219.1 | NC_014250.1 | NC_020072 | NC_015936 | NC_006504 |
| NC_022082.1 | NC_014618.1 | NC_022654.1 | NC_004191 | NC_001503 | NC_006507 |
| NC_022566.1 | NC_021291.1 | NC_012752.1 | NC_004189 | NC_001630 | NC_006496 |
| NZ_APGM01000001.1 | NC_015682.1 | NC_012226.1 | NC_004181 | NC_008186 | NC_006508 |
| NC_011365.1 | NC_021313.1 | NC_014629.1 | NC_004190 | NC_008185 | NC_010704 |
| NC_010125.1 | NC_022592.1 | NC_013438.1 | NC_004182 | NC_011619 | NC_010708 |
| NC_010296.1 | NC_021487.1 | NC_013852.1 | NC_004180 | NC_011618 | NC_010707 |
| NC_009515.1 | NC_022571.1 | NC_013862.1 | NC_004184 | NC_014793 | NC_011549 |
| NC_012891.1 | NC_022198.1 | NC_014634.1 | NC_004187 | NC_005053 | NC_007180 |
| NC_017567.1 | NC_004463.1 | NC_014633.1 | NC_004186 | NC_002200 | NC_019945 |
| NC_018712.1 | NC_022093.1 | NC_013742.1 | NC_004185 | NC_004609 | NC_017084 |
| NC_019042.1 | NC_022567.1 | NC_014818.1 | NC_004188 | NC_004608 | NC_020804 |
| NC_022532.1 | NC_022521.1 | NC_014819.1 | NC_002361 | NC_018869 | NC_001672 |
| NZ_CM001076.1 | NC_022524.1 | NC_013157.1 | NC_018088 | NC_001983 | NC_013461 |
| NC_007761.1 | NC_022664.1 | NC_014957.1 | NC_001343 | NC_001984 | NC_013460 |
| NC_010994.1 | NC_022781.1 | NC_013409.1 | NC_016996 | NC_011550 | NC_004074 |
| NC_021905.1 | NC_022785.1 | NC_013408.1 | NC_007523 | NC_001356 | NC_020487 |
| NC_007963.1 | NZ_CM002280.1 | NC_019956.1 | NC_009644 | NC_004065 | NC_004366 |
| NC_010161.1 | NZ_CM002285.1 | NC_012983.1 | NC_009646 | NC_002512 | NC_006458 |
| NC_009012.1 | NC_022904.1 | NC_012972.1 | NC_008492 | NC_001826 | NC_005057 |
| NC_017304.1 | NZ_CP007506.1 | NC_012972.1 | NC_008492 | NC_019559 | NC_004546 |

TABLE 4-continued

GenBank accession numbers of published prokaryote
chromosome and plasmid sequences, and virus sequences (including
entry version number ".N"; GenBank database release 202, 15 Jun. 2014)

| | | | | | |
|---|---|---|---|---|---|
| NZ_CM001015.1 | NC_022997.1 | NC_012970.1 | NC_008493 | NC_014899 | NC_003722 |
| NZ_CM000913.1 | NC_023001.1 | NC_011743.1 | NC_020475 | NC_012584 | NC_001555 |
| NC_017717.1 | NC_023033.1 | NZ_CM001144.1 | NC_020473 | NC_018702 | NC_018935 |
| NC_018747.1 | NC_023063.1 | NZ_CM001146.1 | NC_006358 | NC_001846 | NC_004654 |
| NC_015470.1 | NC_013771.1 | NZ_CM001143.1 | NC_006359 | NC_000942 | NC_004641 |
| NC_017287.1 | NC_019814.1 | NZ_CM001147.1 | NC_009799 | NC_008311 | NC_014597 |
| NC_017291.1 | NC_020285.1 | NZ_CM001145.1 | NC_009816 | NC_001506 | NC_014596 |
| NC_017289.1 | NC_019815.1 | NC_016972.1 | NC_012800 | NC_001505 | NC_009553 |
| NC_017292.1 | NC_020283.1 | NC_017766.1 | NC_006648 | NC_001515 | NC_004356 |
| NC_017290.1 | NC_020294.1 | NC_020894.1 | NC_006636 | NC_001702 | NC_005060 |
| NC_018619.1 | NC_020299.1 | NC_020293.1 | NC_006637 | NC_000943 | NC_005030 |
| NC_018620.1 | NC_020284.1 | NC_014155.1 | NC_006641 | NC_022597 | NC_002817 |
| NC_018627.1 | NC_020913.1 | NC_014154.1 | NC_006649 | NC_022596 | NC_013800 |
| NC_018621.1 | NC_021353.1 | NZ_CM000771.1 | NC_006638 | NC_022595 | NC_005049 |
| NC_018622.1 | NC_016027.1 | NZ_CM000773.1 | NC_006640 | NC_014326 | NC_001556 |
| NC_018623.1 | NC_022547.1 | NZ_CM000772.1 | NC_006639 | NC_010671 | NC_001367 |
| NC_018624.1 | NC_018605.1 | NC_015944.1 | NC_006633 | NC_006561 | NC_001557 |
| NC_018625.1 | NC_017955.1 | NC_023012.1 | NC_006642 | NC_006147 | NC_001777 |
| NC_018626.1 | NC_020063.1 | NC_023011.1 | NC_006643 | NC_001633 | NC_003487 |
| NC_020248.1 | NC_020417.1 | NC_013264.1 | NC_006644 | NC_023597 | NC_003811 |
| NC_014796.1 | NC_007511.1 | NC_013265.1 | NC_006645 | NC_008194 | NC_003805 |
| NC_019391.1 | NC_007509.1 | NC_013263.1 | NC_006646 | NC_023602 | NC_005096 |
| NC_011835.1 | NC_007510.1 | NC_013954.1 | NC_006647 | NC_023603 | NC_005097 |
| NC_012814.1 | NC_008576.1 | NC_017391.1 | NC_006657 | NC_023607 | NC_003889 |
| NC_012815.1 | NC_009338.1 | NC_017388.1 | NC_006650 | NC_023701 | NC_003844 |
| NC_017214.1 | NC_011979.1 | NC_017389.1 | NC_006634 | NC_022328 | NC_003845 |
| NC_017217.1 | NC_022600.1 | NC_017392.1 | NC_006651 | NC_010763 | NC_003842 |
| NC_017215.1 | NC_017954.1 | NC_014305.1 | NC_006659 | NC_023591 | NC_009994 |
| NC_017216.2 | NZ_CM001023.1 | NC_014304.1 | NC_006653 | NC_022058 | NC_003378 |
| NC_017834.1 | NC_017856.1 | NC_012847.1 | NC_006654 | NC_023723 | NC_010732 |
| NC_017866.1 | NC_017857.1 | NC_015852.1 | NC_006662 | NC_023742 | NC_001768 |
| NC_017867.1 | NC_020541.1 | NC_015854.1 | NC_006661 | NC_023716 | NC_015628 |
| NC_021593.1 | NC_014145.1 | NC_015853.1 | NC_006660 | NC_023862 | NC_015627 |
| NC_022523.1 | NC_023004.1 | NC_015851.1 | NC_006658 | NC_012788 | NC_003822 |
| NC_009725.1 | NC_023003.1 | NC_013958.1 | NC_006652 | NC_014458 | NC_014823 |
| NC_017188.1 | NZ_CP007268.1 | NZ_AKKM01000049.1 | NC_006635 | NC_022087 | NC_003836 |
| NC_014551.1 | NC_004129.6 | NZ_CM001856.1 | NC_006656 | NC_021348 | NC_003838 |
| NC_017190.1 | NC_016114.1 | NC_022123.1 | NC_006655 | NC_013936 | NC_003837 |
| NC_017191.1 | NC_020796.1 | NC_022114.1 | NC_016924 | NC_022977 | NC_004904 |
| NC_020272.1 | NC_015216.1 | NC_017762.1 | NC_004580 | NC_021349 | NC_004439 |
| NC_017912.1 | NC_015574.1 | NZ_ALIR01000018.1 | NC_004581 | NC_023698 | NC_004440 |
| NC_016784.1 | NZ_CM001046.1 | NZ_ALIR01000019.1 | NC_004582 | NC_010762 | NC_003890 |
| NC_017061.1 | NC_017026.1 | NZ_ALIR01000020.1 | NC_014897 | NC_021533 | NC_021851 |
| NC_019842.1 | NC_017528.1 | NZ_ALIR01000021.1 | NC_007219 | NC_023697 | NC_001554 |
| NC_020410.1 | NC_021003.1 | NC_020165.1 | NC_007290 | NC_022331 | NC_003826 |
| NC_022075.1 | NC_021004.1 | NC_020266.1 | NC_013803 | NC_022327 | NC_005843 |
| NC_022081.1 | NZ_CM002258.1 | NC_020266.1 | NC_013802 | NC_004689 | NC_007340 |
| NC_022530.1 | NZ_CM002259.1 | NC_020268.1 | NC_012137 | NC_023747 | NC_007341 |
| NC_022653.1 | NZ_CM001157.1 | NC_020264.1 | NC_013593 | NC_023562 | NC_015962 |
| NC_023073.1 | NZ_CM001156.1 | NC_020267.1 | NC_009740 | NC_022983 | NC_015961 |
| NC_004350.2 | NC_017463.1 | NC_020274.1 | NC_006935 | NC_009878 | NC_003664 |
| NC_013928.1 | NC_017173.1 | NC_020265.1 | NC_002510 | NC_023692 | NC_003665 |
| NC_018089.1 | NC_017174.1 | NC_010813.1 | NC_004583 | NC_023739 | NC_013076 |
| NC_017768.1 | NZ_CM001861.1 | NC_014750.1 | NC_018082 | NC_023713 | NC_013075 |
| NC_013446.2 | NZ_CM001976.1 | NC_014641.1 | NC_009535 | NC_022055 | NC_010836 |
| NC_002946.2 | NZ_CM001978.1 | NC_014642.1 | NC_004607 | NC_011054 | NC_010835 |
| NC_011035.1 | NZ_CM001982.1 | NC_015657.1 | NC_007721 | NC_021296 | NC_004675 |
| NC_022240.1 | NZ_CM001048.1 | NC_015664.1 | NC_003199 | NC_022988 | NC_016581 |
| NC_017511.1 | NZ_CM001050.1 | NC_004632.1 | NC_003200 | NC_011291 | NC_016580 |
| NC_017960.1 | NZ_CM001052.1 | NC_004633.1 | NC_017827 | NC_023687 | NC_021579 |
| NC_017022.1 | NZ_CM001972.1 | NC_007274.1 | NC_015327 | NC_021061 | NC_001507 |
| NC_020207.1 | NZ_CM001977.1 | NC_007275.1 | NC_017829 | NC_011286 | NC_001508 |
| NC_021994.1 | NZ_CM001980.1 | NZ_CM001803.1 | NC_014545 | NC_002656 | NC_008057 |
| NZ_CM000742.1 | NZ_CM001985.1 | NZ_CM001802.1 | NC_004013 | NC_004687 | NC_008058 |
| NZ_CM000743.1 | NZ_CM001834.1 | NZ_CM000957.1 | NC_003542 | NC_004682 | NC_013258 |
| NZ_CM000744.1 | NZ_ANOI01000001.1 | NC_013284.1 | NC_003543 | NC_021324 | NC_013259 |
| NC_011138.3 | NZ_CM001974.1 | NC_013283.1 | NC_003541 | NC_023606 | NC_009030 |
| NC_018632.1 | NZ_CM001981.1 | NC_013285.1 | NC_014730 | NC_011271 | NC_003891 |
| NC_018678.1 | NZ_ARWD01000001.1 | NC_015165.1 | NC_003550 | NC_022057 | NC_010148 |
| NC_018692.1 | NZ_CM001859.1 | NC_015168.1 | NC_003549 | NC_008207 | NC_014594 |
| NC_018679.1 | NZ_CM002793.1 | NC_015166.1 | NC_003535 | NC_011284 | NC_004614 |
| NC_019393.1 | NC_022759.1 | NC_014753.1 | NC_006952 | NC_023729 | NC_014747 |
| NC_021716.1 | NZ_CM002796.1 | NC_014316.1 | NC_003545 | NC_008203 | NC_013639 |
| NC_023045.1 | NC_018655.1 | NC_014317.1 | NC_003544 | NC_004680 | NC_010439 |
| NC_021717.1 | NC_015496.1 | NC_015314.1 | NC_003663 | NC_004683 | NC_004544 |
| NC_021712.1 | NC_020537.1 | NC_015313.1 | NC_008794 | NC_004686 | NC_005320 |

TABLE 4-continued

GenBank accession numbers of published prokaryote chromosome and plasmid sequences, and virus sequences (including entry version number ".N"; GenBank database release 202, 15 Jun. 2014)

| | | | | | |
|---|---|---|---|---|---|
| NC_021713.1 | NC_020536.1 | NC_016888.1 | NC_003924 | NC_021338 | NC_021205 |
| NC_021714.1 | NC_020532.1 | NC_015665.1 | NC_005302 | NC_021318 | NC_010441 |
| NC_021710.1 | NC_020564.1 | NC_015661.1 | NC_005300 | NC_004681 | NC_023038 |
| NC_010943.1 | NC_020529.1 | NC_014135.1 | NC_005301 | NC_022965 | NC_023034 |
| NC_011071.1 | NC_021195.1 | NC_014132.1 | NC_018276 | NC_022973 | NC_010313 |
| NC_015947.1 | NC_022548.1 | NC_014134.1 | NC_023614 | NC_022065 | NC_008373 |
| NC_017671.1 | NC_022537.1 | NC_014131.1 | NC_018575 | NC_008195 | NC_008329 |
| NZ_CM001824.1 | NC_021991.1 | NC_014133.1 | NC_017974 | NC_004685 | NC_004558 |
| NC_014638.1 | NC_022777.1 | NC_015963.1 | NC_021531 | NC_023690 | NC_004559 |
| NC_014616.1 | NC_021285.1 | NC_015969.1 | NC_023717 | NC_014459 | NC_013102 |
| NC_017999.1 | NC_022541.1 | NC_014908.1 | NC_019934 | NC_022071 | NC_018614 |
| NC_012803.1 | NC_022543.1 | NC_014911.1 | NC_019927 | NC_001900 | NC_015124 |
| NZ_CM000776.2 | NC_022528.1 | NC_015423.1 | NC_019509 | NC_011022 | NC_008727 |
| NC_011134.1 | Prokaryotes - Plasmids RefSeq | NC_015727.1 | NC_018454 | NC_021859 | NC_005842 |
| NC_012471.1 | NC_022587.1 | NC_015724.1 | NC_019398 | NC_023744 | NC_005031 |
| NC_012470.1 | NC_011339.1 | NC_005241.1 | NC_019400 | NC_022068 | NC_005497 |
| NC_017582.1 | NC_011338.1 | NC_009673.1 | NC_019401 | NC_023696 | NC_010236 |
| NC_006526.2 | NC_011337.1 | NC_014918.1 | NC_019402 | NC_023728 | NC_007723 |
| NC_013355.1 | NC_011341.1 | NZ_CM000959.1 | NC_020078 | NC_023552 | NC_019546 |
| NC_017262.1 | NC_011342.1 | NC_006128.1 | NC_013801 | NC_023704 | NC_003897 |
| NC_015709.1 | NC_011340.1 | NC_006129.1 | NC_008579 | NC_023703 | NC_008523 |
| NC_018145.1 | NZ_ABLB01000068.1 | NC_007505.1 | NC_004300 | NC_022059 | NC_011135 |
| NC_022900.1 | NZ_ABLB01000067.1 | NC_007504.1 | NC_014473 | NC_023721 | NC_011096 |
| NC_002754.1 | NZ_CM001849.1 | NC_007507.1 | NC_007922 | NC_023708 | NC_004613 |
| NC_017274.1 | NC_017194.1 | NC_007506.1 | NC_001492 | NC_021306 | NC_023312 |
| NC_011852.1 | NC_020422.1 | NC_013745.1 | NC_003534 | NC_022325 | NC_006874 |
| NC_021521.1 | NC_020421.1 | NC_013747.1 | NC_000960 | NC_013650 | NC_004648 |
| NC_002677.1 | NC_020420.1 | NC_013746.1 | NC_006431 | NC_023564 | NC_005348 |
| NC_011896.1 | NC_022125.1 | NC_013748.1 | NC_021223 | NC_023553 | NC_006876 |
| NC_013209.1 | NC_012732.1 | NC_013749.1 | NC_021222 | NC_023726 | NC_010440 |
| NC_017100.1 | NC_001773.1 | NC_013744.1 | NC_004046 | NC_015584 | NC_005359 |
| NC_017121.1 | NC_018583.1 | NC_014254.1 | NC_005068 | NC_023712 | NC_004611 |
| NC_017125.1 | NC_018580.1 | NC_015162.1 | NC_021708 | NC_020876 | NC_004612 |
| NC_017146.1 | NC_018582.1 | NC_015170.1 | NC_004725 | NC_021302 | NC_012206 |
| NC_017111.1 | NC_020503.1 | NC_015169.1 | NC_002633 | NC_022753 | NC_014542 |
| NC_017150.1 | NC_021553.1 | NC_015163.1 | NC_001801 | NC_011288 | NC_012789 |
| NC_017108.1 | NZ_CM001854.1 | NZ_AGFH01000030.1 | NC_007816 | NC_023746 | NC_008299 |
| NC_002663.1 | NZ_CM001855.1 | NC_015319.1 | NC_002034 | NC_023686 | NC_010840 |
| NC_016808.1 | NZ_CM001853.1 | NC_015322.1 | NC_002035 | NC_009993 | NC_010839 |
| NC_017027.1 | NC_008790.1 | NC_017471.1 | NC_001440 | NC_021346 | NC_012493 |
| NC_017764.1 | NC_008770.1 | NC_017472.1 | NC_002602 | NC_022085 | NC_012492 |
| NZ_CM001580.1 | NC_017284.1 | NC_014719.1 | NC_008614 | NC_022979 | NC_009570 |
| NZ_CM001581.1 | NC_014801.1 | NC_015951.1 | NC_001469 | NC_011290 | NC_005032 |
| NZ_CM002276.1 | NC_017282.1 | NC_015952.1 | NC_006941 | NC_021308 | NC_008517 |
| NC_013198.1 | NC_022354.1 | NC_017553.1 | NC_003688 | NC_008202 | NC_016965 |
| NC_017482.1 | NZ_AZNT01000024.1 | NC_017533.1 | NC_018174 | NC_022056 | NC_009031 |
| NC_013199.1 | NZ_AZNS01000034.1 | NC_016817.1 | NC_018173 | NC_022975 | NC_009606 |
| NC_017491.1 | NC_021361.1 | NC_018026.1 | NC_002984 | NC_022981 | NC_009605 |
| NC_021723.1 | NZ_CM001562.1 | NC_014763.1 | NC_002985 | NC_023554 | NC_004647 |
| NC_021725.1 | NC_003277.1 | NC_014754.1 | NC_004809 | NC_022069 | NC_005855 |
| NC_010336.1 | NC_003385.1 | NC_014756.1 | NC_004810 | NC_023740 | NC_013413 |
| NC_011959.1 | NC_003384.1 | NC_014755.1 | NC_005875 | NC_011020 | NC_003898 |
| NC_013410.1 | NC_016855.1 | NC_014563.1 | NC_008604 | NC_021538 | NC_014741 |
| NC_017448.1 | NC_006855.1 | NC_014561.1 | NC_003084 | NC_021535 | NC_012205 |
| NC_011744.2 | NC_006856.1 | NC_014258.1 | NC_018703 | NC_023600 | NC_004153 |
| NC_011753.2 | NC_009140.1 | NC_015980.1 | NC_012685 | NC_023604 | NC_018864 |
| NC_015857.1 | NC_011079.1 | NC_015979.1 | NC_010252 | NC_022984 | NC_004715 |
| NC_015858.1 | NC_012124.1 | NC_015632.1 | NC_010254 | NC_011019 | NC_003896 |
| NC_020995.1 | NC_011082.1 | NC_015219.1 | NC_010986 | NC_022061 | NC_002743 |
| NC_002696.2 | NC_011081.1 | NC_014409.1 | NC_010985 | NC_011292 | NC_008524 |
| NC_011916.1 | NC_011092.1 | NC_014226.1 | NC_015521 | NC_011056 | NC_014510 |
| NC_003318.1 | NC_011093.1 | NC_017508.1 | NC_016657 | NC_023702 | NC_019032 |
| NC_003317.1 | NC_011148.1 | NC_017507.1 | NC_020865 | NC_001335 | NC_010988 |
| NC_012442.1 | NC_011204.1 | NC_013940.1 | NC_020854 | NC_023745 | NC_010987 |
| NC_012441.1 | NC_016858.1 | NC_014975.1 | NC_020857 | NC_023724 | NC_010834 |
| NC_017244.1 | NC_016859.1 | NC_014007.1 | NC_016658 | NC_014461 | NC_010833 |
| NC_017245.1 | NC_017675.1 | NC_014009.1 | NC_016659 | NC_021556 | NC_009491 |
| NC_017246.1 | NC_017718.1 | NC_014005.1 | NC_021071 | NC_023705 | NC_009490 |
| NC_017247.1 | NC_017719.1 | NC_017385.1 | NC_020855 | NC_023689 | NC_003868 |
| NC_017248.1 | NC_017720.1 | NC_017386.1 | NC_016656 | NC_023714 | NC_003867 |
| NC_017283.1 | NC_016864.1 | NC_014626.1 | NC_022751 | NC_022086 | NC_005851 |
| NC_012880.1 | NC_016825.1 | NC_014621.1 | NC_013021 | NC_008196 | NC_005850 |
| NC_013592.1 | NC_017054.1 | NC_015513.1 | NC_019516 | NC_011021 | NC_002692 |
| NC_014500.1 | NC_017624.1 | NC_015511.1 | NC_020872 | NC_023572 | NC_001828 |
| NC_014103.1 | NC_016861.1 | NC_015512.1 | NC_021072 | NC_023733 | NC_001917 |

TABLE 4-continued

GenBank accession numbers of published prokaryote
chromosome and plasmid sequences, and virus sequences (including
entry version number ".N"; GenBank database release 202, 15 Jun. 2014)

| | | | | | |
|---|---|---|---|---|---|
| NC_014019.1 | NC_016862.1 | NC_017935.1 | NC_023884 | NC_022054 | NC_015122 |
| NC_017138.1 | NC_020306.1 | NC_015695.1 | NC_023883 | NC_021305 | NC_022230 |
| NC_012724.2 | NC_020308.1 | NC_015694.1 | NC_011097 | NC_011273 | NC_001938 |
| NC_012721.2 | NC_021156.1 | NC_015693.1 | NC_003791 | NC_022976 | NC_001939 |
| NC_021043.1 | NC_021155.1 | NC_015705.1 | NC_003792 | NC_023725 | NC_017824 |
| NC_021011.1 | NC_021157.1 | NC_015704.1 | NC_014930 | NC_021310 | NC_003825 |
| NC_016826.1 | NC_021842.2 | NC_014917.1 | NC_014928 | NC_011044 | NC_003839 |
| NC_017731.1 | NC_021813.2 | NC_014298.1 | NC_014927 | NC_023565 | NC_003840 |
| NC_021022.1 | NC_021869.1 | NC_014301.1 | NC_021707 | NC_023578 | NC_002555 |
| NC_021015.1 | NC_021811.1 | NC_014303.1 | NC_014929 | NC_023577 | NC_002556 |
| NC_002967.9 | NC_021841.1 | NC_014302.1 | NC_002816 | NC_023711 | NC_020258 |
| NZ_CM001794.1 | NC_021819.1 | NC_014300.1 | NC_001812 | NC_004688 | NC_020257 |
| NZ_CM001795.1 | NC_021845.1 | NC_014299.1 | NC_003532 | NC_008197 | NC_004642 |
| NZ_CM001796.1 | NC_021843.1 | NC_014749.1 | NC_004009 | NC_008198 | NC_009612 |
| NZ_CM001797.1 | NC_021816.1 | NC_015595.1 | NC_016154 | NC_005259 | NC_009607 |
| NZ_CM001798.1 | NC_021815.1 | NC_015184.1 | NC_003020 | NC_008200 | NC_002050 |
| NC_012560.1 | NC_021817.1 | NC_016819.1 | NC_003023 | NC_008205 | NC_002052 |
| NC_021149.1 | NC_022570.1 | NC_016835.1 | NC_003021 | NC_011287 | NC_002051 |
| NC_021150.1 | NZ_CM001063.1 | NC_017092.1 | NC_003024 | NC_022053 | NC_009032 |
| NC_002678.2 | NZ_CM001152.1 | NC_017807.1 | NC_003022 | NC_023691 | NC_009013 |
| NC_003047.1 | NZ_CM001154.1 | NC_017060.1 | NC_003018 | NC_021297 | NC_009893 |
| NC_017322.1 | NZ_CM001473.1 | NC_017773.1 | NC_003019 | NC_013694 | NC_005058 |
| NC_015591.1 | NZ_CM001472.1 | NC_015386.1 | NC_003016 | NC_021299 | NC_019532 |
| NC_015596.1 | NC_011076.1 | NC_012586.1 | NC_003025 | NC_023720 | NC_004044 |
| NC_015590.1 | NC_011077.1 | NC_000914.2 | NC_003017 | NC_011057 | NC_008374 |
| NC_017325.1 | NC_011078.1 | NC_016813.1 | NC_003015 | NC_022969 | NC_008267 |
| NC_018700.1 | NC_011215.1 | NC_016814.1 | NC_003014 | NC_021311 | NC_005812 |
| NC_019845.1 | NC_011214.1 | NC_016815.1 | NC_003012 | NC_022063 | NC_005811 |
| NC_020528.1 | NZ_AMLT01000070.1 | NC_016836.1 | NC_003008 | NC_012027 | NC_004569 |
| NC_002977.6 | NC_003132.1 | NC_015742.1 | NC_003011 | NC_022329 | NC_007485 |
| NC_019382.1 | NC_003131.1 | NC_022225.1 | NC_003010 | NC_021309 | NC_003828 |
| NC_018829.1 | NC_003134.1 | NC_013164.1 | NC_003009 | NC_008199 | NC_022229 |
| NC_002927.3 | NC_004838.1 | NZ_CM001476.1 | NC_003013 | NC_023737 | NC_004903 |
| NC_018828.1 | NC_009377.1 | NC_015955.1 | NC_003015 | NC_011055 | NC_000869 |
| NC_002928.3 | NC_009378.1 | NC_015959.1 | NC_003006 | NC_011039 | NC_000870 |
| NC_002929.2 | NC_005815.1 | NC_013502.1 | NC_010670 | NC_011023 | NC_005059 |
| NC_017223.1 | NC_005816.1 | NC_015970.1 | NC_010663 | NC_022330 | NC_009548 |
| NC_018518.1 | NC_005813.1 | NC_015967.1 | NC_010664 | NC_008204 | NC_009560 |
| NC_002940.2 | NC_005814.1 | NC_015876.1 | NC_010662 | NC_011289 | NC_021341 |
| NC_003103.1 | NC_008118.1 | NC_014549.1 | NC_010665 | NC_023730 | NC_004005 |
| NC_009446.1 | NC_008119.1 | NC_014548.1 | NC_010666 | NC_022066 | NC_010126 |
| NC_004757.1 | NC_008122.1 | NC_019898.1 | NC_010667 | NC_022064 | NC_017913 |
| NC_011206.1 | NC_008121.1 | NC_019969.1 | NC_010661 | NC_023609 | NC_011348 |
| NC_011761.1 | NC_008120.1 | NC_019961.1 | NC_010668 | NC_023710 | NC_005853 |
| NC_008255.1 | NC_010157.1 | NC_022534.1 | NC_010669 | NC_011272 | NC_005852 |
| NC_007643.1 | NC_010158.1 | NC_022533.1 | NC_019491 | NC_004684 | NC_019947 |
| NC_017584.1 | NC_017153.1 | NC_015667.1 | NC_019495 | NC_023732 | NC_019946 |
| NC_010175.1 | NC_017156.1 | NC_015659.1 | NC_009127 | NC_021303 | NC_007727 |
| NC_014833.1 | NC_017155.1 | NC_015658.1 | NC_018616 | NC_023699 | NC_007726 |
| NC_001263.1 | NC_017158.1 | NC_014718.1 | NC_018716 | NC_017973 | NC_010950 |
| NC_001264.1 | NC_017159.1 | NC_014723.1 | NC_018718 | NC_023580 | NC_010949 |
| NC_009785.1 | NC_017157.1 | NC_013442.1 | NC_023842 | NC_022324 | NC_010491 |
| NC_003030.1 | NC_014017.1 | NC_013516.1 | NC_008028 | NC_022326 | NC_010490 |
| NC_017295.1 | NC_014027.1 | NC_013518.1 | NC_008020 | NC_011269 | NC_010489 |
| NC_015687.1 | NC_014022.1 | NC_013519.1 | NC_003537 | NC_021307 | NC_014071 |
| NC_008530.1 | NC_017266.1 | NC_013531.1 | NC_018715 | NC_021301 | NC_014087 |
| NC_003212.1 | NC_017264.1 | NC_013596.1 | NC_018717 | NC_023748 | NC_014072 |
| NZ_CM001049.1 | NC_017263.1 | NC_013737.1 | NC_002190 | NC_011267 | NC_009225 |
| NC_016802.1 | NC_017169.1 | NC_013731.1 | NC_019544 | NC_011270 | NC_014093 |
| NC_016799.1 | NC_017170.1 | NC_013738.1 | NC_006967 | NC_023741 | NC_014097 |
| NC_016782.1 | NC_009596.1 | NC_013732.1 | NC_006966 | NC_023563 | NC_014086 |
| NC_016783.1 | NC_009595.1 | NC_013733.1 | NC_004830 | NC_003387 | NC_014088 |
| NC_016800.1 | NC_009141.1 | NC_013734.1 | NC_013697 | NC_023738 | NC_014090 |
| NC_016787.1 | NC_003140.1 | NC_013736.1 | NC_001524 | NC_023731 | NC_014089 |
| NC_016801.1 | NC_017336.1 | NC_013735.1 | NC_001523 | NC_011285 | NC_014095 |
| NC_016788.1 | NC_017334.1 | NC_014149.1 | NC_001789 | NC_022062 | NC_014082 |
| NC_016785.1 | NC_017335.1 | NC_014159.1 | NC_001522 | NC_023707 | NC_014068 |
| NC_016786.1 | NC_002774.1 | NC_014213.1 | NC_006555 | NC_009820 | NC_002195 |
| NC_016790.1 | NC_005951.1 | NC_014214.1 | NC_005898 | NC_009877 | NC_014070 |
| NC_016789.1 | NC_006629.2 | NC_014736.1 | NC_005899 | NC_023498 | NC_014092 |
| NC_002935.2 | NC_007791.1 | NC_014732.1 | NC_001477 | NC_022060 | NC_014085 |
| NC_008596.1 | NC_007792.1 | NC_014735.1 | NC_001474 | NC_023695 | NC_015783 |
| NC_018289.1 | NC_007790.1 | NC_014737.1 | NC_001475 | NC_023727 | NC_002076 |
| NC_019966.1 | NC_009477.1 | NC_014731.1 | NC_002640 | NC_021334 | NC_014076 |
| NZ_CM001762.1 | NC_012417.1 | NC_013201.1 | NC_008494 | NC_022067 | NC_014075 |
| NC_007333.1 | NC_010063.1 | NC_013224.1 | NC_008495 | NC_014901 | NC_014077 |

TABLE 4-continued

GenBank accession numbers of published prokaryote chromosome and plasmid sequences, and virus sequences (including entry version number ".N"; GenBank database release 202, 15 Jun. 2014)

| | | | | | |
|---|---|---|---|---|---|
| NC_000912.1 | NC_009619.1 | NC_020182.1 | NC_011335 | NC_022070 | NC_014096 |
| NC_017504.1 | NC_013451.1 | NC_020180.1 | NC_001278 | NC_022052 | NC_014091 |
| NC_016807.1 | NC_013452.1 | NC_018066.1 | NC_011086 | NC_008206 | NC_014078 |
| NC_020076.1 | NC_013453.1 | NC_018067.1 | NC_001899 | NC_023709 | NC_014480 |
| NC_002771.1 | NC_017352.1 | NC_015409.1 | NC_019925 | NC_022985 | NC_014083 |
| NC_000909.1 | NC_017332.1 | NC_015430.1 | NC_003857 | NC_021063 | NC_014079 |
| NC_007355.1 | NC_017339.1 | NC_015561.1 | NC_003856 | NC_001942 | NC_014074 |
| NC_000917.1 | NC_017345.1 | NC_015560.1 | NC_018579 | NC_002515 | NC_014073 |
| NC_002578.1 | NC_022126.1 | NZ_CM001485.1 | NC_014547 | NC_005964 | NC_014081 |
| NC_000853.1 | NC_016942.1 | NC_015258.1 | NC_001478 | NC_010748 | NC_014069 |
| NC_023151.1 | NC_017348.1 | NC_015179.1 | NC_022614 | NC_010751 | NC_014094 |
| NC_021214.1 | NC_017350.1 | NC_015181.1 | NC_022615 | NC_010750 | NC_014080 |
| NC_003364.1 | NC_017346.1 | NC_015180.1 | NC_021147 | NC_010749 | NC_014084 |
| NC_004432.1 | NC_017344.1 | NC_015187.1 | NC_021148 | NC_010747 | NC_012126 |
| NC_007517.1 | NC_020534.1 | NC_015189.1 | NC_009010 | NC_010746 | NC_023988 |
| NC_003155.4 | NC_020535.1 | NC_015182.1 | NC_013699 | NC_010745 | NC_003783 |
| NC_008800.1 | NC_020539.1 | NC_015178.1 | NC_002801 | NC_010744 | NC_016898 |
| NC_015224.1 | NC_021552.1 | NC_015188.1 | NC_002800 | NC_010753 | NC_006563 |
| NC_017564.1 | NC_021657.1 | NC_015382.1 | NC_002802 | NC_010752 | NC_014361 |
| NC_002939.5 | NC_022227.1 | NC_015378.1 | NC_002797 | NC_010743 | NC_003824 |
| NC_017454.1 | NC_022228.1 | NC_015377.1 | NC_003711 | NC_007525 | NC_003873 |
| NC_007794.1 | NC_022610.1 | NC_015383.1 | NC_003710 | NC_007529 | NC_004034 |
| NC_002689.2 | NC_022605.1 | NC_015461.1 | NC_019029 | NC_007531 | NC_008518 |
| NC_000961.1 | NC_021060.1 | NC_017029.1 | NC_019030 | NC_007524 | NC_002560 |
| NC_000854.2 | NC_010066.1 | NC_017020.1 | NC_005233 | NC_007534 | NC_002559 |
| NC_007356.1 | NZ_AKYW01000028.1 | NC_017021.1 | NC_005234 | NC_007536 | NC_002558 |
| NC_002936.3 | NZ_AUPT01000023.1 | NC_015517.1 | NC_005235 | NC_007532 | NC_002566 |
| NC_009455.1 | NZ_AUPU01000021.1 | NC_021913.1 | NC_005338 | NC_007533 | NC_002561 |
| NC_013552.1 | NZ_AUPU01000024.1 | NC_015598.1 | NC_005283 | NC_007535 | NC_002567 |
| NC_013890.1 | NZ_AUPW01000021.1 | NC_015603.1 | NC_016997 | NC_007528 | NC_002562 |
| NC_020386.1 | NZ_AUPS01000031.1 | NZ_AFRV01000010.1 | NC_022894 | NC_007526 | NC_002563 |
| NC_020387.1 | NZ_AUPS01000033.1 | NZ_AFRV01000009.1 | NC_021197 | NC_007527 | NC_002565 |
| NC_022964.1 | NZ_AUPS01000028.1 | NC_015670.1 | NC_008034 | NC_003886 | NC_002557 |
| NC_000918.1 | NZ_AUPS01000034.1 | NC_017242.1 | NC_023853 | NC_003885 | NC_002564 |
| NC_010628.1 | NZ_AUPS01000027.1 | NC_015756.1 | NC_023855 | NC_011310 | NC_007383 |
| NC_010364.1 | NC_005005.1 | NC_015904.1 | NC_023886 | NC_005341 | NC_012799 |
| NC_003361.3 | NC_005006.1 | NC_015905.1 | NC_023869 | NC_021246 | NC_015210 |
| NC_002620.2 | NC_005004.1 | NC_015906.1 | NC_023868 | NC_003085 | NC_014904 |
| NZ_ACUJ01000001.3 | NC_005007.1 | NC_015907.1 | NC_023867 | NC_001132 | NC_015629 |
| NC_002570.2 | NC_005003.1 | NC_015916.1 | NC_023866 | NC_005040 | NC_005226 |
| NC_021592.1 | NC_005008.1 | NC_015915.1 | NC_023427 | NC_015874 | NC_005228 |
| NC_003888.3 | NC_006663.1 | NC_015918.1 | NC_023436 | NC_005954 | NC_005227 |
| NC_003106.2 | NC_008503.1 | NC_015922.1 | NC_023428 | NC_008266 | NC_003833 |
| NC_007973.1 | NC_008507.1 | NC_015911.1 | NC_023429 | NC_008824 | NC_003834 |
| NC_007503.1 | NC_008504.1 | NC_015920.1 | NC_023430 | NC_023628 | NC_003835 |
| NC_007951.1 | NC_008506.1 | NC_015917.1 | NC_023431 | NC_001441 | NC_004322 |
| NC_007952.1 | NC_008505.1 | NC_015910.1 | NC_023432 | NC_008552 | NC_002199 |
| NC_007953.1 | NC_013657.1 | NC_015909.1 | NC_023433 | NC_011541 | NC_007020 |
| NC_002978.6 | NC_017488.1 | NC_015903.1 | NC_023434 | NC_017937 | NC_002794 |
| NC_004344.2 | NC_017484.1 | NC_015908.1 | NC_023435 | NC_004084 | NC_014564 |
| NC_016893.1 | NC_017485.1 | NC_015919.1 | NC_023854 | NC_016959 | NC_022612 |
| NC_003910.7 | NC_017487.1 | NZ_CM002263.1 | NC_019498 | NC_011538 | NC_022613 |
| NC_003911.12 | NC_017483.1 | NZ_CM002262.1 | NC_023872 | NC_008252 | NC_001958 |
| NC_004193.1 | NC_017495.1 | NC_015845.1 | NC_023871 | NC_005906 | NC_002470 |
| NC_003413.1 | NC_017493.1 | NZ_ADWW01000011.1 | NC_023870 | NC_005905 | NC_005790 |
| NC_018092.1 | NC_017497.1 | NZ_ADWW01000012.1 | NC_019497 | NC_023843 | NC_010800 |
| NC_000916.1 | NC_017496.1 | NZ_AFEU01000007.1 | NC_018862 | NC_007679 | NC_018400 |
| NC_003552.1 | NC_019433.1 | NC_017074.1 | NC_012958 | NC_016963 | NC_021201 |
| NC_003551.1 | NC_019438.1 | NC_017073.1 | NC_001834 | NC_007916 | NC_023858 |
| NC_003901.1 | NC_019436.1 | NC_017076.1 | NC_013135 | NC_002617 | NC_023887 |
| NC_020389.1 | NC_019431.1 | NC_017069.1 | NC_013499 | NC_013955 | NC_003821 |
| NC_002932.3 | NC_019437.1 | NC_017078.1 | NC_022580 | NC_024017 | NC_004033 |
| NC_004369.1 | NC_019430.1 | NC_017072.1 | NC_004177 | NC_016994 | NC_006451 |
| NC_004113.1 | NC_019434.1 | NC_017077.1 | NC_004169 | NC_021566 | NC_014324 |
| NC_008531.1 | NC_019432.1 | NC_017071.1 | NC_001813 | NC_021567 | NC_002509 |
| NC_016805.1 | NC_004721.2 | NC_017070.1 | NC_012437 | NC_003658 | NC_013218 |
| NC_007912.1 | NC_005707.1 | NC_022044.1 | NC_007220 | NC_003656 | NC_013219 |
| NC_008312.1 | NC_007106.1 | NC_022050.1 | NC_008250 | NC_003659 | NC_004553 |
| NC_004347.2 | NC_007105.1 | NC_022043.1 | NC_001344 | NC_003657 | NC_001873 |
| NC_007797.1 | NC_007107.1 | NC_022049.1 | NC_023985 | NC_003655 | NC_004063 |
| NC_021879.1 | NC_007103.1 | NC_022042.1 | NC_004157 | NC_003654 | NC_003743 |
| NC_021880.1 | NC_007104.1 | NC_016936.1 | NC_004159 | NC_003653 | NC_011109 |
| NC_021881.1 | NC_011973.1 | NC_019790.1 | NC_004158 | NC_003660 | NC_008184 |
| NC_006397.1 | NC_011971.1 | NC_019789.1 | NC_007609 | NC_003652 | NC_009019 |
| NC_006396.1 | NC_011654.1 | NC_018751.1 | NC_023841 | NC_003661 | NC_023424 |
| NC_010645.1 | NC_011656.1 | NC_019895.1 | NC_020810 | NC_008030 | NC_001618 |

TABLE 4-continued

GenBank accession numbers of published prokaryote chromosome and plasmid sequences, and virus sequences (including entry version number ".N"; GenBank database release 202, 15 Jun. 2014)

| | | | | | |
|---|---|---|---|---|---|
| NC_012483.1 | NC_011655.1 | NC_019894.1 | NC_004630 | NC_023851 | NC_014791 |
| NC_007798.1 | NC_011657.1 | NC_019893.1 | NC_004625 | NC_002728 | NC_023766 |
| NC_004547.2 | NC_011775.1 | NC_012790.1 | NC_011583 | NC_016569 | NC_023765 |
| NC_015761.1 | NC_011774.1 | NC_012794.1 | NC_011584 | NC_002690 | NC_010797 |
| NC_021870.1 | NC_011777.1 | NC_013412.1 | NC_022645 | NC_002691 | NC_010739 |
| NC_012004.1 | NC_011771.1 | NC_014651.1 | NC_022644 | NC_009017 | NC_021874 |
| NC_004552.2 | NC_011776.1 | NC_014916.1 | NC_004655 | NC_007919 | NC_020997 |
| NZ_CM001168.1 | NC_012473.1 | NC_022092.1 | NC_004656 | NC_002251 | NC_023547 |
| NC_007899.1 | NC_014332.1 | NC_021183.1 | NC_004674 | NC_001959 | NC_021873 |
| NC_004663.1 | NC_014331.1 | NC_016618.1 | NC_004676 | NC_020901 | NC_003823 |
| NC_005027.1 | NC_014333.1 | NC_016594.1 | NC_007728 | NC_018705 | NC_006551 |
| NC_005955.1 | NC_016780.1 | NC_016619.1 | NC_003899 | NC_001990 | NC_005220 |
| NC_018533.1 | NC_016794.1 | NC_016596.1 | NC_002549 | NC_012703 | NC_005214 |
| NC_014034.1 | NC_016792.1 | NC_016595.1 | NC_016660 | NC_001512 | NC_005221 |
| NC_004557.1 | NC_016774.1 | NC_016597.1 | NC_002687 | NC_001793 | NC_006998 |
| NC_006814.3 | NC_016773.1 | NC_020062.1 | NC_004105 | NC_003633 | NC_017977 |
| NC_015214.1 | NC_016772.1 | NC_020061.1 | NC_008586 | NC_010799 | NC_017099 |
| NC_021181.2 | NC_016793.1 | NC_020060.1 | NC_005092 | NC_002357 | NC_001611 |
| NC_008011.1 | NC_018493.1 | NC_009777.1 | NC_019420 | NC_002358 | NC_006494 |
| NC_020127.1 | NC_018494.1 | NC_022271.1 | NC_020082 | NC_004016 | NC_013415 |
| NC_004917.1 | NC_018492.1 | NC_016149.1 | NC_021342 | NC_004017 | NC_013414 |
| NC_005956.1 | NC_018499.1 | NC_019696.1 | NC_023555 | NC_005136 | NC_014509 |
| NC_008818.1 | NC_003042.1 | NC_019699.1 | NC_022332 | NC_017685 | NC_003906 |
| NC_006087.1 | NC_008263.1 | NC_017942.1 | NC_022581 | NC_003852 | NC_001449 |
| NC_022438.1 | NC_008264.1 | NC_017944.1 | NC_001480 | NC_001728 | NC_010735 |
| NC_020834.1 | NZ_CM001480.1 | NC_017943.1 | NC_023339 | NC_023559 | NC_015631 |
| NC_020833.1 | NZ_CM001479.1 | NC_021886.1 | NC_016744 | NC_023571 | NC_015929 |
| NC_021082.1 | NZ_CM001478.1 | NZ_AMBZ01000023.1 | NC_020068 | NC_023560 | NC_015928 |
| NC_021739.1 | NZ_CM001481.1 | NZ_AMBZ01000024.1 | NC_018615 | NC_019944 | NC_013423 |
| NC_021743.1 | NC_013767.1 | NZ_AMBZ01000025.1 | NC_002701 | NC_014896 | NC_007730 |
| NC_021738.1 | NC_014495.1 | NZ_AMBZ01000022.1 | NC_020474 | NC_014894 | NC_019844 |
| NC_021883.1 | NC_018889.1 | NC_016886.1 | NC_003569 | NC_014745 | NC_002551 |
| NC_004567.2 | NC_021828.1 | NC_016635.1 | NC_003570 | NC_014847 | NC_001560 |
| NC_012984.1 | NC_022045.1 | NC_016636.1 | NC_003568 | NC_009731 | NC_020843 |
| NC_014554.1 | NC_022046.1 | NC_017018.1 | NC_010307 | NC_010620 | NC_023863 |
| NC_020229.1 | NC_022047.1 | NC_016608.1 | NC_012666 | NC_004093 | NC_019457 |
| NC_021224.1 | NC_022051.1 | NC_016606.1 | NC_007346 | NC_013017 | NC_015209 |
| NC_021514.1 | NC_018888.1 | NC_017019.1 | NC_001479 | NC_009532 | NC_015157 |
| NC_008525.1 | NZ_CM001470.1 | NC_016607.1 | NC_000935 | NC_011181 | NC_015158 |
| NC_022780.1 | NC_010942.1 | NC_017017.1 | NC_023873 | NC_011182 | NC_015159 |
| NC_008497.1 | NC_010941.1 | NC_016046.1 | NC_008718 | NC_014906 | NC_021540 |
| NC_020819.1 | NC_010940.1 | NC_019485.1 | NC_019524 | NC_008377 | NC_003313 |
| NC_020064.1 | NC_002128.1 | NC_019775.1 | NC_019524 | NC_014067 | NC_006294 |
| NC_020211.1 | NC_002127.1 | NC_019773.1 | NC_019423 | NC_014066 | NC_005083 |
| NC_004829.2 | NC_017659.1 | NC_020157.1 | NC_023561 | NC_005051 | NC_013651 |
| NC_017502.1 | NC_018660.1 | NC_019774.1 | NC_011045 | NC_004673 | NC_023605 |
| NC_017503.1 | NC_018666.1 | NC_020056.1 | NC_015249 | NC_001721 | NC_020863 |
| NC_018406.1 | NC_018659.1 | NC_017792.1 | NC_022968 | NC_003674 | NC_023569 |
| NC_018407.1 | NC_011749.1 | NC_017791.1 | NC_000924 | NC_003671 | NC_016567 |
| NC_018408.1 | NC_011739.1 | NC_017793.1 | NC_011040 | NC_003673 | NC_020850 |
| NC_018409.1 | NC_011408.1 | NC_017806.1 | NC_004813 | NC_013920 | NC_020868 |
| NC_018410.1 | NC_011416.1 | NC_017805.1 | NC_001426 | NC_006939 | NC_020848 |
| NC_018411.1 | NC_011413.1 | NC_017771.1 | NC_019500 | NC_022962 | NC_016162 |
| NC_018412.1 | NC_011419.1 | NC_019976.1 | NC_019920 | NC_010250 | NC_012757 |
| NC_018413.1 | NC_011407.1 | NC_019975.1 | NC_014662 | NC_010248 | NC_021562 |
| NC_005061.1 | NC_011411.1 | NC_016624.1 | NC_021315 | NC_003348 | NC_004736 |
| NC_005090.1 | NC_013655.1 | NC_016623.1 | NC_010583 | NC_005062 | NC_023568 |
| NC_005085.1 | NC_013354.1 | NC_016587.1 | NC_006949 | NC_005029 | NC_004456 |
| NZ_AABW01000001.1 | NC_013365.1 | NC_016586.1 | NC_011042 | NC_001513 | NC_005879 |
| NC_008095.1 | NC_013370.1 | NC_016585.1 | NC_004301 | NC_007563 | NC_005891 |
| NC_011025.1 | NC_013367.1 | NC_016588.1 | NC_001420 | NC_007559 | NC_009016 |
| NC_005213.1 | NC_013366.1 | NC_017670.1 | NC_002166 | NC_007568 | NC_012662 |
| NC_005126.1 | NC_013368.1 | NC_017669.1 | NC_019768 | NC_007560 | NC_021776 |
| NC_005125.1 | NC_007941.1 | NC_019972.1 | NC_019710 | NC_007561 | NC_022747 |
| NC_005303.2 | NC_009838.1 | NC_018021.1 | NC_019717 | NC_007562 | NC_003327 |
| NC_007947.1 | NC_009837.1 | NC_019967.1 | NC_019714 | NC_007564 | NC_005949 |
| NC_007644.1 | NC_009786.1 | NC_019963.1 | NC_019769 | NC_007565 | NC_005948 |
| NC_010556.1 | NC_009789.1 | NC_018023.1 | NC_019767 | NC_007566 | NC_002362 |
| NC_006055.1 | NC_009790.1 | NC_018022.1 | NC_019724 | NC_007567 | NC_002363 |
| NC_022583.1 | NC_009787.1 | NC_018745.1 | NC_019711 | NC_004049 | NC_003907 |
| NC_008148.1 | NC_009788.1 | NC_018744.1 | NC_019723 | NC_004052 | NC_020488 |
| NC_009664.2 | NC_009791.1 | NC_018742.1 | NC_019719 | NC_004053 | NC_021068 |
| NC_007354.1 | NC_010487.1 | NC_018749.1 | NC_002167 | NC_004054 | NC_004306 |
| NC_014117.1 | NC_010486.1 | NC_018743.1 | NC_018855 | NC_006060 | NC_001956 |
| NC_014118.1 | NC_010485.1 | NC_020292.1 | NC_019922 | NC_013439 | NC_021067 |
| NC_014119.1 | NC_010488.1 | NC_019941.1 | NC_001332 | NC_009609 | NC_021073 |

TABLE 4-continued

GenBank accession numbers of published prokaryote
chromosome and plasmid sequences, and virus sequences (including
entry version number ".N"; GenBank database release 202, 15 Jun. 2014)

| | | | | | |
|---|---|---|---|---|---|
| NC_014539.1 | NC_011351.1 | NC_016113.1 | NC_007856 | NC_009608 | NC_010275 |
| NC_014540.1 | NC_011350.1 | NC_017585.1 | NC_007817 | NC_005336 | NC_021070 |
| NC_015137.1 | NC_013010.1 | NC_023144.1 | NC_014260 | NC_010276 | NC_021529 |
| NC_015136.1 | NC_013942.1 | NC_023145.1 | NC_019501 | NC_001875 | NC_019529 |
| NC_016625.1 | NC_011747.1 | NZ_CM001399.1 | NC_001954 | NC_019409 | NC_020846 |
| NC_016589.1 | NC_011602.1 | NC_018675.1 | NC_002014 | NC_005776 | NC_021534 |
| NC_016590.1 | NC_011603.1 | NC_018674.1 | NC_007291 | NC_005775 | NC_021561 |
| NC_017921.1 | NC_017627.1 | NC_018698.1 | NC_019419 | NC_005777 | NC_019518 |
| NC_017922.1 | NC_013362.1 | NC_018699.1 | NC_012741 | NC_011588 | NC_019722 |
| NC_017920.1 | NC_013369.1 | NC_022879.1 | NC_010105 | NC_007649 | NC_019713 |
| NC_021288.1 | NC_013363.1 | NC_022884.1 | NC_012740 | NC_007647 | NC_007149 |
| NC_021294.1 | NC_014543.1 | NC_022881.1 | NC_008152 | NC_014412 | NC_007241 |
| NC_021287.1 | NC_016903.1 | NC_022880.1 | NC_007637 | NC_014413 | NC_007242 |
| NC_009254.1 | NC_016904.1 | NC_022883.1 | NC_007456 | NC_005881 | NC_007648 |
| NC_009256.1 | NC_017629.1 | NC_016079.1 | NC_015719 | NC_014766 | NC_000855 |
| NC_009255.1 | NC_017630.1 | NZ_CM001372.1 | NC_019707 | NC_020852 | NC_001452 |
| NC_005861.1 | NC_017636.1 | NZ_CM001374.1 | NC_003287 | NC_013288 | NC_009539 |
| NC_008825.1 | NC_017637.1 | NZ_CM001375.1 | NC_001417 | NC_014789 | NC_022559 |
| NC_006085.1 | NC_017722.1 | NC_023136.1 | NC_010237 | NC_010191 | NC_022556 |
| NC_014039.1 | NC_017721.1 | NC_023146.1 | NC_000929 | NC_020071 | NC_022554 |
| NC_017534.1 | NC_017724.1 | NC_017041.1 | NC_001901 | NC_020066 | NC_022555 |
| NC_017535.1 | NC_017723.1 | NZ_AKVZ01000059.1 | NC_018835 | NC_011069 | NC_022562 |
| NC_017550.1 | NC_017640.1 | NC_017055.1 | NC_005856 | NC_011068 | NC_022553 |
| NC_016516.1 | NC_017645.1 | NC_017998.1 | NC_001895 | NC_011070 | NC_022561 |
| NC_016512.1 | NC_016637.1 | NC_017959.1 | NC_002371 | NC_004037 | NC_022560 |
| NC_016511.1 | NC_017642.1 | NC_017959.1 | NC_001609 | NC_007015 | NC_022557 |
| NC_018707.1 | NC_017639.1 | NC_017958.1 | NC_001421 | NC_007646 | NC_022558 |
| NC_021085.1 | NZ_AGTD01000006.1 | NC_017957.2 | NC_009821 | NC_001511 | NC_023440 |
| NC_007168.1 | NZ_AGTD01000002.1 | NC_017966.1 | NC_010324 | NC_002513 | NC_001867 |
| NC_007984.1 | NZ_AGTD01000005.1 | NC_016907.1 | NC_005340 | NC_004560 | NC_004541 |
| NC_009504.1 | NZ_AGTD01000003.1 | NZ_AGFM01000123.1 | NC_001890 | NC_022980 | NC_003355 |
| NC_009505.1 | NZ_AGTD01000004.1 | NZ_AGFM01000122.1 | NC_012638 | NC_021558 | NC_003709 |
| NC_022347.1 | NC_017647.1 | NC_018657.1 | NC_014467 | NC_021865 | NC_003708 |
| NC_022660.1 | NC_017648.1 | NC_017965.1 | NC_008515 | NC_005994 | NC_006262 |
| NC_022132.1 | NC_017649.1 | NZ_AMSD01000003.1 | NC_007023 | NC_005992 | NC_003832 |
| NC_012039.1 | NC_017650.1 | NC_016750.1 | NC_005066 | NC_005988 | NC_003841 |
| NC_013967.1 | NC_017658.1 | NC_019388.1 | NC_012635 | NC_005987 | NC_003843 |
| NC_014760.1 | NC_017653.1 | NC_019387.1 | NC_004928 | NC_005993 | NC_018270 |
| NC_015725.1 | NC_017654.1 | NC_018069.1 | NC_007603 | NC_005989 | NC_012735 |
| NC_018077.1 | NC_017657.1 | NZ_CM001468.1 | NC_004831 | NC_005991 | NC_016575 |
| NC_012440.1 | NC_017655.1 | NC_017081.1 | NC_015269 | NC_005986 | NC_016576 |
| NC_015713.1 | NC_017661.1 | NC_021594.1 | NC_012223 | NC_005995 | NC_009942 |
| NC_012438.1 | NC_017662.1 | NC_017784.1 | NC_005841 | NC_005990 | NC_001563 |
| NC_010803.1 | NC_017665.1 | NC_017811.1 | NC_003444 | NC_019858 | NC_003908 |
| NC_009337.1 | NC_017903.1 | NC_017797.1 | NC_012868 | NC_019855 | NC_016961 |
| NC_013971.1 | NC_017901.1 | NC_017818.1 | NC_005833 | NC_019856 | NC_017828 |
| NC_013961.1 | NC_018651.1 | NC_017786.1 | NC_003298 | NC_019857 | NC_003326 |
| NZ_CBVU010000001.1 | NC_018654.1 | NC_017815.1 | NC_000866 | NC_014252 | NC_009805 |
| NZ_CBVU010000004.1 | NC_018652.1 | NC_017795.1 | NC_005859 | NC_021858 | NC_001886 |
| NZ_CBVU010000002.1 | NC_018663.1 | NC_017816.1 | NC_001604 | NC_022098 | NC_012931 |
| NZ_CBVU010000008.1 | NC_018662.1 | NC_017777.1 | NC_009540 | NC_003847 | NC_002350 |
| NZ_CBVU010000006.1 | NC_022651.1 | NC_017787.1 | NC_020414 | NC_002598 | NC_002349 |
| NZ_CBVU010000007.1 | NC_022661.1 | NC_017775.1 | NC_000902 | NC_001647 | NC_011533 |
| NZ_CBVU010000003.1 | NC_022650.1 | NC_017801.1 | NC_007821 | NC_003521 | NC_008516 |
| NZ_CBVU010000005.1 | NC_022649.1 | NC_017796.1 | NC_011356 | NC_019454 | NC_006276 |
| NZ_CBVT010000007.1 | NC_022662.1 | NC_017800.1 | NC_001330 | NC_015585 | NC_006275 |
| NZ_CBVT010000005.1 | NC_007414.1 | NC_017822.1 | NC_009514 | NC_014707 | NC_021094 |
| NZ_CBVT010000004.1 | NZ_DS999999.1 | NC_017810.1 | NC_022750 | NC_009555 | NC_021095 |
| NZ_CBVT010000008.1 | NZ_AFET01000005.1 | NC_017794.1 | NC_019503 | NC_005321 | NC_003820 |
| NZ_CBVT010000002.1 | NZ_AHAU01000167.1 | NC_017798.1 | NC_001416 | NC_005844 | NC_016991 |
| NZ_CBVT010000003.1 | NZ_AWFJ01000122.1 | NC_017814.1 | NC_019706 | NC_023292 | NC_010700 |
| NZ_CBVT010000006.1 | NZ_AWFJ01000135.1 | NC_017779.1 | NC_019708 | NC_004706 | NC_010703 |
| NZ_CBVT010000001.1 | NC_002142.1 | NC_017789.1 | NC_019704 | NC_004147 | NC_016995 |
| NZ_CBVS010000004.1 | NC_010720.1 | NC_017778.1 | NC_019716 | NC_005028 | NC_004426 |
| NZ_CBVS010000006.1 | NC_010719.1 | NC_017819.1 | NC_019709 | NC_018449 | NC_009744 |
| NZ_CBVS010000002.1 | NZ_AETX01000217.1 | NC_017812.1 | NC_019705 | NC_001748 | NC_015780 |
| NZ_CBVS010000001.1 | NZ_AFYG01000108.1 | NC_017783.1 | NC_010106 | NC_001785 | NC_010951 |
| NZ_CBVS010000003.1 | NZ_AFVX01000096.1 | NC_017788.1 | NC_003356 | NC_007653 | NC_010948 |
| NZ_CBVS010000005.1 | NC_008087.1 | NC_017780.1 | NC_001422 | NC_018450 | NC_007216 |
| NZ_CBVS010000008.1 | NC_011334.1 | NC_017782.1 | NC_019517 | NC_017716 | NC_011639 |
| NZ_CBVS010000007.1 | NC_011499.1 | NC_017802.1 | NC_014792 | NC_004106 | NC_004107 |
| NC_016620.1 | NC_017383.1 | NC_017809.1 | NC_019399 | NC_006430 | NC_009424 |
| NC_010554.1 | NC_014556.1 | NC_017817.1 | NC_019403 | NC_009924 | NC_020205 |
| NC_022000.1 | NC_017356.1 | NC_017774.1 | NC_019404 | NC_009923 | NC_019933 |
| NC_010981.1 | NC_017364.1 | NC_017781.1 | NC_019718 | NC_000852 | NC_001396 |
| NC_016612.1 | NC_017363.1 | NC_017813.1 | NC_019526 | NC_009899 | NC_007709 |

TABLE 4-continued

GenBank accession numbers of published prokaryote
chromosome and plasmid sequences, and virus sequences (including
entry version number ".N"; GenBank database release 202, 15 Jun. 2014)

| | | | | | |
|---|---|---|---|---|---|
| NC_018106.1 | NC_017373.1 | NC_017776.1 | NC_019720 | NC_008603 | NC_007710 |
| NC_009617.1 | NC_014257.1 | NC_017785.1 | NC_019715 | NC_009898 | NC_009543 |
| NC_008536.1 | NC_017377.1 | NC_017821.1 | NC_019721 | NC_010756 | NC_004902 |
| NC_009792.1 | NC_017380.1 | NC_017820.1 | NC_018086 | NC_010761 | NC_007024 |
| NC_009778.1 | NC_017064.1 | NC_017799.1 | NC_017732 | NC_003691 | NC_012742 |
| NC_017933.1 | NC_017734.1 | NC_023497.1 | NC_012419 | NC_003692 | NC_017981 |
| NC_020260.1 | NC_017919.1 | NC_018288.1 | NC_015270 | NC_005854 | NC_020903 |
| NC_023032.1 | NC_017369.1 | NC_018291.1 | NC_023551 | NC_005848 | NC_010955 |
| NC_011059.1 | NC_017370.1 | NC_018287.1 | NC_023595 | NC_005849 | NC_002331 |
| NC_006138.1 | NC_019562.1 | NZ_AMWZ01000014.1 | NC_009904 | NC_016561 | NC_004197 |
| NC_009879.1 | NC_019561.1 | NC_017736.1 | NC_013696 | NC_003628 | NC_022982 |
| NC_016929.1 | NC_019565.1 | NC_017738.1 | NC_013646 | NC_022089 | NC_022987 |
| NC_009881.1 | NC_019564.1 | NC_020305.1 | NC_013643 | NC_018226 | NC_013599 |
| NC_013929.1 | NC_020556.1 | NC_019700.1 | NC_013648 | NC_018576 | NC_008094 |
| NC_009925.1 | NC_002253.1 | NC_019694.1 | NC_013644 | NC_018530 | NC_005179 |
| NC_011060.1 | NC_002252.1 | NC_019758.1 | NC_001612 | NC_014411 | NC_002642 |
| NC_008554.1 | NC_004555.1 | NC_020050.1 | NC_001472 | NC_008292 | NC_016441 |
| NC_008346.1 | NC_011878.1 | NC_019744.1 | NC_002058 | NC_015552 | NC_019412 |
| NC_007796.1 | NC_017257.1 | NC_019737.1 | NC_001430 | NC_014790 | NC_004752 |
| NC_007520.2 | NC_017258.1 | NC_019755.1 | NC_001859 | NC_012786 | NC_022895 |
| NC_007575.1 | NC_017261.1 | NC_019756.1 | NC_021220 | NC_012787 | NC_002031 |
| NC_007404.1 | NC_017260.1 | NC_019733.1 | NC_004441 | NC_008193 | NC_022801 |
| NC_006300.1 | NC_017286.1 | NC_019735.1 | NC_003988 | NC_001368 | NC_004176 |
| NC_006361.1 | NC_002490.1 | NC_019736.1 | NC_013695 | NC_002036 | NC_004168 |
| NC_006371.1 | NC_002489.3 | NC_019734.1 | NC_010415 | NC_003854 | NC_008694 |
| NC_006370.1 | NC_004554.1 | NC_019754.1 | NC_024073 | NC_003629 | NC_004745 |
| NC_006624.1 | NC_010579.1 | NC_019765.1 | NC_004994 | NC_003853 | NC_005069 |
| NC_012778.1 | NC_017561.1 | NC_019749.1 | NC_004136 | NC_023154 | NC_023715 |
| NC_012028.1 | NZ_AXBS01000046.1 | NC_020052.1 | NC_004137 | NC_023156 | NC_011038 |
| NC_012029.1 | NC_018746.1 | NC_019750.1 | NC_018875 | NC_023158 | NC_019911 |
| NC_008740.1 | NC_019906.1 | NC_019766.1 | NC_003083 | NC_023157 | NC_004777 |
| NC_017067.1 | NZ_CM001836.1 | NC_022739.1 | NC_011065 | NC_023155 | NC_016163 |
| NC_012115.1 | NC_011987.1 | NC_008042.1 | NC_011066 | NC_023160 | NC_019909 |
| NC_006513.1 | NC_011994.1 | NC_008043.1 | NC_011067 | NC_023159 | NC_019919 |
| NC_007929.1 | NC_011990.1 | NC_021056.1 | NC_013401 | NC_023161 | NC_001271 |
| NC_017481.1 | NZ_AFSD01000008.1 | NZ_CM001166.1 | NC_013404 | NC_001671 | NC_015960 |
| NC_006582.1 | NZ_AFSD01000007.1 | NZ_CM002272.1 | NC_013403 | NC_004995 | NC_005039 |
| NC_006674.1 | NC_020801.1 | NZ_CM002274.1 | NC_013402 | NC_023310 | NC_004422 |
| NC_019396.1 | NC_020798.1 | NZ_CM002275.1 | NC_013398 | NC_023297 | NC_007665 |
| NC_007498.2 | NC_020797.1 | NC_015223.1 | NC_013400 | NC_023296 | NC_007664 |
| NC_021089.1 | NZ_CM002270.1 | NC_015221.1 | NC_013399 | NC_023308 | NC_007663 |
| NC_012084.1 | NZ_CM002269.1 | NC_002608.1 | NC_013397 | NC_023309 | NC_007662 |
| NC_009655.1 | NC_021277.1 | NC_001869.1 | NC_013405 | NC_023303 | NC_007658 |
| NC_011988.1 | NC_009506.1 | NC_018225.1 | NC_013396 | NC_023298 | NC_007657 |
| NC_011989.1 | NC_007323.3 | NC_020563.2 | NC_004195 | NC_023311 | NC_007656 |
| NC_014219.1 | NC_007322.2 | NC_010476.1 | NC_001491 | NC_009892 | NC_007661 |
| NC_009614.1 | NC_012577.1 | NC_010474.1 | NC_001650 | NC_011552 | NC_007659 |
| NC_014121.1 | NC_012579.1 | NC_010478.1 | NC_001844 | NC_001634 | NC_007660 |
| NC_018079.1 | NC_012656.1 | NC_010479.1 | NC_017826 | NC_003668 | NC_015325 |
| NC_016514.1 | NC_012655.1 | NC_010480.1 | NC_011644 | NC_003672 | NC_022990 |
| NC_018405.1 | NC_017726.1 | NC_010477.1 | NC_002532 | NC_002600 | NC_011560 |
| NC_021046.1 | NC_017727.1 | NC_019681.1 | NC_010327 | NC_002039 | NC_012532 |
| NC_008609.1 | NC_003980.1 | NC_019691.1 | NC_002201 | NC_002038 | NC_005047 |
| NC_008700.1 | NC_003981.1 | NC_019692.1 | NC_001450 | NC_002040 | NC_005874 |
| NC_007954.1 | NZ_AMDT01000056.1 | NC_017446.1 | NC_012123 | NC_003855 | NC_003878 |
| NC_008345.1 | NC_004851.1 | NC_017443.1 | NC_020500 | NC_004723 | NC_023175 |
| NC_013892.1 | NC_017321.1 | NC_017442.1 | NC_020902 | NC_018837 | NC_003224 |
| NC_014228.1 | | | | | NC_006059 |
| NC_014147.1 | | | | | NC_003874 |

In another aspect of the present invention, a reference set of artificial NA molecules simulating transcript variants, preferably RNA molecules or DNA molecules, especially RNA molecules, is provided comprising at least one, preferably at least two, more preferably at least three, especially at least five families of NA molecules, with each family consisting of at least two, preferably at least three, more preferably at least four, especially at least five different NA molecules, wherein, independently for each family, all NA molecules of said each family are reference transcript variants of the same artificial gene, and wherein, independently for each family, the NA molecules of said each family share a sequence of at least 80 nt in length, preferably at least 100 nt, more preferably at least 150 nt, especially at least 200 nt, and at least two NA molecules of said each family differ by at least another sequence of at least 80 nt length, preferably at least 100 nt, more preferably at least 150 nt, even more preferably at least 200 nt, especially at least 300 nt.

In the course of the present invention, a reference set of artificial NA molecules was found which is exceptionally suitable for the purposes of the present invention. These molecules were called SIRVs (Spike-in RNA variants) and are disclosed for the present invention in SEQ ID NOs: 1-148 (see Example 1). Therefore, in another aspect, the present invention provides an NA molecule, preferably a DNA molecule or RNA molecule, comprising a sequence of at least 50%, preferably at least 60%, more preferably at least 70%, even more preferably at least 80%, yet even more preferably at least 90% or at least 95%, especially 100% identical to an entire sequence selected from the group of SEQ ID NOs: 1-148. Large variation of these sequences is possible as no biological function needs to be preserved given that the sequences are only for use as reference sequences in a NA analysis method. Preferably the variants to these SEQ ID NOs do not have similarity to sequences of Table 3, as said above. These variants could be obtained by the method described above.

As the exons of the SIRVs are well suited for the purposes of the present invention in their own right, even when they are included into another sequence, the present invention also provides a NA molecule, preferably a DNA molecule or RNA molecule, comprising a sequence with at least one exon with a sequence at least 50%, preferably at least 60%, more preferably at least 70%, even more preferably at least 80%, yet even more preferably at least 90% or at least 95%, especially 100% identical to an entire sequence selected from the group of SEQ ID NOs: 156-334.

In addition, also fragments of the SIRVs are useful for the purposes of the present invention, when they are included into another NA molecule. Hence the present invention also provides a NA molecule, preferably a DNA molecule or RNA molecule, comprising a sequence of at least 80, preferably at least 150, preferably at least 200, more preferably at least 300, especially at least 400 consecutive nucleotides, which sequence is at least 50%, preferably at least 60%, more preferably at least 70%, even more preferably at least 80%, yet even more preferably at least 90% or at least 95%, especially 100% identical to a sequence fragment, with a minimum size of at least 80 nt, preferably at least 150 nt, preferably at least 200 nt, more preferably at least 300 nt, especially at least 400 nt, of a sequence selected from SEQ ID NOs: 1-148.

In a preferred embodiment, the NA molecules of the present invention are provided as a reference set of artificial NA molecules simulating transcript variants, comprising at least one, preferably at least two, more preferably at least three, especially at least five families of NA molecules, with each family consisting of at least two, preferably at least three, more preferably at least four, especially at least five different NA molecules of the present invention, wherein, independently for each family, all NA molecules of said each family are reference transcript variants of the same artificial gene, and wherein, independently for each family, the NA molecules of said each family share a sequence of at least 80 nt in length, preferably at least 100 nt, more preferably at least 150 nt, especially at least 200 nt, and at least two NA molecules of said each family differ by at least another sequence of at least 80 nt length, preferably at least 100 nt, more preferably at least 150 nt, even more preferably at least 200 nt, especially at least 300 nt.

Preferably, any reference set of the present invention simulates at least one, preferably at least two, more preferably at least three, even more preferably at least five, especially all alternative transcription events selected from the group of:

alternative transcript start sites (TSS), alternative transcript end sites (TES), antisense transcripts, overlapping transcripts, and alternative splicing events selected from the group of skipped cassette exon (CE), intron retention (IR), mutually exlusive exons (MXE), alternative 3' splice sites (A3SS), alternatives 5' splice sites (A5SS), alternative first exon (AFE), alternative last exon (ALE) and trans-splicing.

In another preferred embodiment of any reference set of the present invention, at least 50%, preferably at least 75%, especially at least 95% of all intron start dinucleotides within all exon sequences of the reference set of artificial NA molecules are GT, wherein each of said intron start dinucleotides is a 5' terminal dinucleotide of a sequence that is not present in another artificial NA molecule of the reference set and thereby represents an intron for said another artificial NA molecule, and/or (preferably "and") at least 50%, preferably at least 75%, especially at least 95% of all intron end dinucleotides within all exon sequences of the reference set of artificial NA molecules are AT, wherein each of said intron end dinucleotides is a 5' terminal dinucleotide of a sequence that is not present in another artificial NA molecule of the reference set and thereby represents an intron for said another artificial NA molecule.

In another preferred embodiment, any reference set of the present invention has a mean sequence length of 500 nt to 2000 nt, preferably 750 nt to 1500 nt, especially of 1000 nt to 1400 nt; and preferably with a standard deviation of 300 nt to 1200 nt, preferably 600 nt to 900 nt, especially 700 nt to 800 nt; with a minimum size of at least 100 nt; and preferably with a maximum size of 10000 nt.

In another preferred embodiment, any reference set of the present invention has an average GC content from 25% to 55%.

In another preferred embodiment, any reference set of the present invention has essentially randomly distributed occurrences of 5' start trinucleotides selected from GAA, GAC, GAG, GAT, GCA, GCC, GCG, GCT, GGA, GGC, GGG, GGT, GTA, GTC, GTG, GTT or of 5' start dinucleotides selected from AA, AC, AG, AT, CA, CC, CG, CT, GA, GC, GG, GT, TA, TC, TG, TT and/or of 3' end dinucleotides selected from AC, AG, AT, CC, CG, CT, GC, GG, GT, TC, TG, TT.

In another preferred embodiment, each artificial NA molecule of any reference set of the present invention has a guanosine as 5' start nucleotide.

In another preferred embodiment, at least one, preferably each, of the artificial NA molecules of any reference set of the present invention, if it is an RNA molecule, has a 5'-cap structure and/or has a poly(A) tail of at least 10, preferably at least 20, especially at least 30 adenosines. Preferably, the sequences of any reference set of the present invention do not have similarity to sequences whose NCBI GenBank database accession numbers are listed in Table 3, preferably in any one of Table 3 and Table 4, especially to all sequences of NCBI GenBank database release 202 of 15 Jun. 2014, with a statistical significance threshold (Expect threshold) of less than $10^{-1}$, preferably less than 1, especially less than 10, wherein the similarity is determined by the BLASTn programme with the following parameters: word size of 28, with filtering low complexity regions, linear gap costs and match/mismatch scores of 1,−2.

In a particularly preferred embodiment, any reference set of artificial NA molecules of the present invention is provided, wherein at least two, preferably each, of the NA molecules is present in a preset molar amount, preferably in the same container; and preferably wherein the respective molar amount of at least two of the NA molecules differ by the order of at least two magnitudes, preferably at least three magnitudes, more preferably at least five magnitudes, especially at least six magnitudes, and in particular wherein the at least two of the NA molecules are provided dissolved in liquid or ready to dissolve or dilute in liquid wherein their respective concentrations or final concentrations range between 0.01 attomoles/µl and 100 femtomoles/µl, or between 100 zeptomoles/µl and 1 femtomole/µl. Having a large range of concentrations allows, for instance, to better evaluate instruments and methods (e.g. in RNA-seq) because it is more challenging to develop instruments and methods that have a high dynamic range of detection.

As discussed above, stabilisation and reduction of handling errors is important. Accordingly, in another, especially preferred embodiment the reference set of artificial NA molecules of the present invention is provided dried, preferably freeze-dried, in a container, preferably together with stabilising agents.

It is possible to convert DNA sequences into RNA sequences (exchange of nucleotides: T→U) and vice versa (exchange of nucleotides: U→T). Therefore, whenever a sequence is given as a DNA sequence herein (including the sequence listing), it shall also be read as the respective RNA sequence thereof and vice versa. As used herein, an RNA is typically single-stranded whereas a DNA molecule is typically double-stranded. However, also the respective RNA/DNA in double-stranded/single-stranded form shall be claimed for the present invention, as well as sequences complementary (e.g. cDNA) to the sequences claimed.

The length of at least one or more, e.g. all, NA molecules may be e.g. 100 to 1000000 nucleotides, preferably 130 to 100000 nucleotides or 150 to 10000 nucleotides.

In preferred embodiments, the naturally-occurring or artificial gene encodes a protein (e.g. mRNA), but also stipulated are non protein-coding transcripts, such as regulatory or catalytic RNA, including microRNA, snoRNA or rRNA, as well as their precursors, in particular pre-microRNA or pre-rRNA.

As used herein "gene" relates to genetic nucleotides with a sequence that is transcribed to form one or more transcripts.

As used herein "isoform" or "transcript variant" is used to relate to a particular variant of a transcript.

"About" as used herein may refer to the same value or a value differing by +/−10% of the given value.

"Comprises" as used herein shall be understood as an open definition, allowing further members as in containing. "Consisting" on the other hand is considered as a closed definition without further elements of the consisting definition feature. Thus "comprising" is a broader definition and contains the "consisting" definition. Any definitions herein using the "comprising" language may also be read with a consisting limitation in a special embodiment of the invention.

The nucleic acid sequencing step can be performed by any method known in the art, such as PCR sequencing. Such method include Maxam-Gilbert sequencing, Chain-termination methods, Shotgun sequencing, Bridge PCR, Massively parallel signature sequencing (MPSS), Polony sequencing, pyrosequencing, Illumina (Solexa) sequencing, SOLiD sequencing, Ion semiconductor sequencing, DNA nanoball sequencing, Heliscope single molecule sequencing, Single molecule real time (SMRT) sequencing, Nanopore DNA sequencing, Sequencing by hybridization, Sequencing with mass spectrometry, Microfluidic Sanger sequencing, Microscopy-based techniques, RNAP sequencing, In vitro virus high-throughput sequencing.

As used herein, "orders of magnitude" means "orders of decimal magnitude", for instance spanning "six orders of magnitude" (also called "order of six magnitudes" herein) means spanning values e.g. from 1 to $1 \times 10^6$ or from $2 \times 10^{-7}$ to 0.2.

Any inventive method or step can be performed as computer-implemented method except when explicitly excluded. Even the usually wet-chemistry steps of sequencing and synthesizing NA molecules may be assisted by a computer, e.g. to control and obtain data from an automated or semi-automated sequence reader. The computer program product or memory device may also be provided with a read generation component that obtains short reads from a sample, such as a sequencer, preferably a sequencer comprising a computer component. For example, computer readable media can include but are not limited to magnetic storage devices (e.g., hard disk, floppy disk, magnetic strips, . . . ), optical disks (e.g., compact disk (CD), digital versatile disk (DVD), . . . ), smart cards, and flash memory devices (e.g., card, stick, key drive, . . . ).

"Percent (%) sequence identity" with respect to a reference nucleotide sequence is defined as the percentage of nucleotides in a candidate sequence that are identical with the nucleotides in the reference sequence, after aligning the sequences and introducing gaps, if necessary, to achieve the maximum percent sequence identity, and not considering any conservative substitutions as part of the sequence identity. Gaps cause a lack of identity. Alignment for purposes of determining percent nucleotide sequence identity can be achieved in various ways that are within the skill in the art, for instance, using publicly available computer software such as BLAST, BLAST-2, ALIGN, ALIGN-2, Megalign (DNASTAR) or the "needle" pairwise sequence alignment application of the EMBOSS software package. Those skilled in the art can determine appropriate parameters for aligning sequences, including any algorithms needed to achieve maximal alignment over the full length of the sequences being compared. For purposes herein, however, % nucleotide sequence identity values are calculated using the sequence alignment of the computer programme "needle" of the EMBOSS software package (publicly available from European Molecular Biology Laboratory; Rice et al., EMBOSS: the European Molecular Biology Open Software Suite, Trends Genet. 2000 June; 16(6):276-7, PMID: 10827456).

The needle programme can be accessed under the web site http://www.ebi.ac.uk/Tools/psa/emboss needle/nucleotide.html or downloaded for local installation as part of the EMBOSS package from http://emboss.sourceforge.net/. It runs on many widely-used UNIX operating systems, such as Linux.

To align two nucleotide sequences, the needle programme is preferably run with the following parameters:

Commandline: needle-auto-stdout-asequence SEQUENCE_FILE_A-bsequence SEQUENCE_FILE_B-datafile EDNAFULL-gapopen 10.0-gapextend 0.5-endopen 10.0-endextend 0.5-aformat3 pair-snucleotide1-snucleotide2 (Align format: pair Report file: stdout)

The % nucleotide sequence identity of a given nucleotide sequence A to, with, or against a given nucleotide sequence B (which can alternatively be phrased as a given nucleotide sequence A that has or comprises a certain % nucleotide sequence identity to, with, or against a given nucleotide sequence B) is calculated as follows:

$$100 \text{ times the fraction } X/Y$$

where X is the number of nucleotides scored as identical matches by the sequence alignment program needle in that program's alignment of A and B, and where Y is the total number of nucleotides in B. It will be appreciated that where the length of nucleotide sequence A is not equal to the length of nucleotide sequence B, the % nucleotide sequence identity of A to B will not equal the % nucleotide sequence identity of B to A. In cases where "a sequence of A is at least N % identical to the entire sequence of B", Y is the entire length of B. Unless specifically stated otherwise, all % nucleotide sequence identity values used herein are obtained as described in the immediately preceding paragraph using the needle computer program.

"Sequence similarity", "sequence identity", "sharing a sequence" and similar terms shall also apply to the reverse complement of a sequence, i.e. the expression "sequence A is 80% identical to sequence B" shall also be true if "sequence A is 80% identical to the reverse complement (or antisense sequence) of sequence B".

Herein, the term "insertion" in relation to NA sequences can also mean insertion directly at the 5' or 3' end (i.e. addition at the 5' or 3' end).

Exemplary Embodiments

A particularly preferred embodiment of a method of the present invention is:

A method for the controlled identification and/or quantification of transcript variants in one or more samples, comprising:

a) providing a reference set of artificial NA molecules simulating transcript variants, comprising at least three different families of NA molecules, with each family consisting of at least three different NA molecules, wherein, independently for each family, all NA molecules of said each family are reference transcript variants of the same artificial gene, and wherein, independently for each family, the NA molecules of said each family share a sequence of at least 80 nucleotides (nt) in length, preferably at least 100 nt, more preferably at least 150 nt, especially at least 200 nt, and at least two NA molecules of said each family differ by at least another sequence of at least nt length, preferably at least 100 nt, more preferably at least 150 nt, even more preferably at least 200 nt, especially at least 300 nt, and wherein each of the artificial NA molecules is present in preset molar amounts; and further wherein each of the artificial NA molecules:

has a length of at least 100 nt and comprises at least one artificial exon, wherein said shared sequence is comprised in a single artificial exon sequence, and wherein the reference set of said NA molecules:

has an average GC content from 25% to 55%, and simulates at least five alternative transcription events selected from the group of:

alternative transcript start sites (TSS), alternative transcript end sites (TES), antisense transcripts, overlapping transcripts, and alternative splicing events selected from the group of skipped cassette exon (CE), intron retention (IR), mutually exclusive exons (MXE), alternative 3' splice sites (A3SS), alternatives 5' splice sites (ASSS), alternative first exon (AFE), alternative last exon (ALE) and trans-splicing, and wherein at least 75% of all 5' start dinucleotides of the exon sequences of the reference set of artificial NA molecules are GT and at least 75% of all 3' end dinucleotides of the exon sequences of the reference set of artificial NA molecules are AT, and wherein the sequences of said reference set do not have similarity to sequences whose NCBI GenBank database accession numbers are listed in any one of Table 3 and Table 4 with a statistical significance threshold (Expect threshold) of less than 10, wherein the similarity is determined by the BLASTn programme with the following parameters: word size of 28, with filtering low complexity regions, linear gap costs and match/mismatch scores of 1,−2; and b) adding said reference set as external control to the one or more samples comprising transcript variants; and c) performing NA sequencing based on read generation and assignment wherein a reference read assignment is generated with the reads of the reference set and said reference read assignment is used to control, verify, or modify the read assignment of the transcript variants of the one or more samples.

REFERENCES

Aird S D, et al., (2013) Quantitative high-throughput profiling of snake venom gland transcriptomes and proteomes (*Ovophis okinavensis* and *Protobothrops flavoviridis*). BMC Genomics 14:790.

Benson D A, et al., "GenBank." *Nucleic acids research* (2012). doi: 10.1093/nar/gks1195.

Blomquist, Thomas M., et al. "Targeted RNA-sequencing with competitive multiplex-PCR amplicon libraries." (2013): e79120.

Brennecke P, et al., (2013) Accounting for technical noise in single-cell RNA-seq experiments. Nature Methods 10(11): 1093.

Chaitanya R S, et al. (2008) Overlapping genes in the human and mouse genomes. BMC Genomics 2008, 9:169.

Cronin M, et al., (2004) Universal RNA Reference Materials for Gene Expression. Clinical Chemistry 50(8): 1464-1471.

Devonshire A S, et al., (2010) "Evaluation of external RNA controls for the standardisation of gene expression biomarker measurements." *BMC genomics* 11.1: 662.

External RNA Controls Consortium, (2005) Proposed methods for testing and selecting the ERCC external RNA controls. BMC Genomics 6:150. Available at www-.biomedcentral.com//1471-2164/6/150.

External RNA Controls Consortium, (2005a) The External RNA Controls Consortium: a progress report. Nature Methods 2:731-734.

ERCC User Guide: ERCC RNA Spike-In Control Mixes (English). Life Technologies (2012). Publication Number 4455352, Revision D.

Hu Y, et al., (2014) PennSeq: accurate isoform-specific gene expression quantification in RNA-Seq by modeling non-uniform read distribution. Nucleic Acids Research 42:3 e20.

James H B, et al., (2010) Evaluation of statistical methods for normalization and differential expression in mrna-seq experiments. BMC Bioinformatics, 11:94.

Jiang L, et al., (2011) Synthetic spike-in standards for RNA-seq experiments. Genome Research 21:1543-1551.

Lin C Y, et al., (2012) Transcriptional Amplification in Tumor Cells with Elevated c-Myc. Cell 151:56-67.

Karlin S, and Altschul S F, (1990) "Methods for assessing the statistical significance of molecular sequence features by using general scoring schemes." *Proceedings of the National Academy of Sciences* 87(6): 2264-2268.

Koscielny G, et al., (2009) ASTD: The Alternative Splicing and Transcript Diversity database. Genomics. 93(3):213-20.

Lovén J, et al., (2012) Revisiting Global Gene Expression Analysis. Cell 151:476-482.

MAQC Consortium, (2006) The MicroArray Quality Control (MAQC) project shows inter- and intraplatform reproducibility of gene expression measurements. Nature Biotechnology, 24(9):1151-1161.

Nilsen T W, and Graveley B R, (2010) Expansion of the eukaryotic proteome by alternative splicing. Nature 463.7280: 457-463.

Rapaport F, et al., (2013) Comprehensive evaluation of differential gene expression analysis methods for RNA-seq data. Genome Biology, 14:R95.

Reid L (ERCC), (2005) Proposed methods for testing and selecting the ERCC external RNA controls. BMC Genomics 2005, 6:150.

Rice P, et al., (2000) EMBOSS: the European Molecular Biology Open Software Suite, Trends Genet, 16(6):276-7.

Roberts A, et al., (2011) Improving RNA-Seq expression estimates by correcting for fragment bias. Genome Biol, 12(3):R22.

Shippy R, et al., (2006) Using RNA sample titrations to assess microarray platform performance and normalization techniques. Nat Biotechnol. 24(9): 1123-1131.

Sun, Bing, Lian Tao, and Yun-Ling Zheng. "Simultaneous quantification of alternatively spliced transcripts in a single droplet digital PCR reaction." BioTechniques 56.6 (2014): 319.

Trapnell C, et al., (2010) Transcript assembly and quantification by RNA-Seq reveals unannotated transcripts and isoform switching during cell differentiation. Nature Biotechnology 28, 511-515.

Wang E T, et al., (2008) Alternative Isoform Regulation in Human Tissue Transcriptomes. Nature 456, 470-476.

Wang Z, et al., (2009) "RNA-Seq: a revolutionary tool for transcriptomics." *Nature Reviews Genetics* 10(1): 57-63.

Xin D, et al., (2008) Alternative Promoters Influence Alternative Splicing at the Genomic Level, PLOS One, DOI: 10.1371/journal.pone.0002377.

Yoon O K, et al., (2012) Genetics and Regulatory Impact of Alternative Polyadenylation in Human B-Lymphoblastoid Cells. PLoS Genet. e1002882, doi: 10.1371/journal.pgen.1002882.

Zhang, Fan, and Renee Drabier. "SASD: the Synthetic Alternative Splicing Database for identifying novel isoform from proteomics." BMC bioinformatics 14.Suppl 14 (2013): S13.

The present invention is further illustrated by the following figures and examples, without being limited to these embodiments of the invention, with each element being combinable with any other embodiment of the invention.

EXAMPLES

Example 1: SIRV Characteristics

TABLE 5

Characteristics of the SIRVs (artificial NA molecules of the present invention, simulating transcript variants). SEQ ID NOs: 75-148 are the identical to SEQ ID NOs: 1-74, respectively, but without the poly(A) tail of 30 adenosines. "No template" means that the SIRV has no direct human transcript model template but instead is obtainable by the inventive product method with steps E)-G). A SIRV family presents transcript variants of the same artificial gene and simulates the conditions of the human model gene.

| Name | Human transcript template | Orientation | Exons | Length | GC content | SEQ ID NO |
|---|---|---|---|---|---|---|
| SIRV1 family | | | | | | |
| SIRV101 | KLK5-001 | sense | 6 | 1591 | 46% | 1 |
| SIRV102 | KLK5-002 | sense | 4 | 1330 | 45% | 2 |
| SIRV103 | KLK5-004 | sense | 6 | 1393 | 45% | 3 |
| SIRV104 | KLK5-005 | sense | 7 | 1429 | 45% | 4 |
| SIRV105 | KLK5-006 | sense | 5 | 700 | 44% | 5 |
| SIRV106 | no template | sense | 3 | 1003 | 45% | 6 |
| SIRV107 | no template | sense, overlapping | 3 | 774 | 45% | 7 |
| SIRV108 | no template | antisense, overlapping | 3 | 732 | 46% | 8 |
| SIRV109 | no template | antisense, overlapping | 3 | 494 | 45% | 9 |
| SIRV2 family | | | | | | |
| SIRV201 | LDHD-001 | sense | 11 | 2081 | 42% | 10 |
| SIRV202 | LDHD-002 | sense | 11 | 2001 | 42% | 11 |
| SIRV203 | LDHD-003 | sense | 5 | 716 | 41% | 12 |
| SIRV204 | LDHD-004 | sense | 3 | 770 | 42% | 13 |
| SIRV205 | no template | antisense | 1 | 553 | 42% | 14 |
| SIRV206 | no template | antisense | 1 | 454 | 40% | 15 |
| SIRV3 family | | | | | | |
| SIRV301 | LGALS17A-001 | sense | 5 | 2497 | 35% | 16 |
| SIRV302 | LGALS17A-002 | sense | 2 | 1837 | 35% | 17 |
| SIRV303 | LGALS17A-004 | sense | 3 | 2048 | 35% | 18 |
| SIRV304 | LGALS17A-005 | sense | 8 | 1113 | 34% | 19 |
| SIRV305 | LGALS17A-006 | sense | 3 | 466 | 32% | 20 |
| SIRV306 | LGALS17A-201 | sense | 3 | 2403 | 36% | 21 |
| SIRV307 | no template | sense | 5 | 809 | 34% | 22 |
| SIRV308 | no template | antisense, overlapping | 3 | 509 | 41% | 23 |
| SIRV309 | no template | antisense, overlapping | 3 | 826 | 43% | 24 |
| SIRV310 | no template | antisense, overlapping | 3 | 619 | 39% | 25 |
| SIRV311 | no template | antisense | 1 | 191 | 30% | 26 |
| SIRV4 family | | | | | | |
| SIRV401 | DAPK3-001 | sense | 9 | 2283 | 39% | 27 |
| SIRV402 | DAPK3-004 | sense | 3 | 2089 | 37% | 28 |
| SIRV403 | DAPK3-005 | sense | 4 | 700 | 38% | 29 |
| SIRV404 | DAPK3-006 | sense | 4 | 622 | 38% | 30 |
| SIRV405 | DAPK3-007 | sense | 2 | 656 | 40% | 31 |
| SIRV406 | DAPK3-008 | sense | 2 | 647 | 42% | 32 |
| SIRV407 | DAPK3-201 | sense | 8 | 2135 | 39% | 33 |

TABLE 5-continued

Characteristics of the SIRVs (artificial NA molecules of the present invention, simulating transcript variants). SEQ ID NOs: 75-148 are the identical to SEQ ID NOs: 1-74, respectively, but without the poly(A) tail of 30 adenosines. "No template" means that the SIRV has no direct human transcript model template but instead is obtainable by the inventive product method with steps E)-G). A SIRV family presents transcript variants of the same artificial gene and simulates the conditions of the human model gene.

| Name | Human transcript template | Orientation | Exons | Length | GC content | SEQ ID NO |
|---|---|---|---|---|---|---|
| SIRV408 | no template | sense | 5 | 600 | 36% | 34 |
| SIRV409 | no template | antisense, overlapping | 3 | 1597 | 44% | 35 |
| SIRV410 | no template | antisense, overlapping | 2 | 980 | 44% | 36 |
| SIRV5 family | | | | | | |
| SIRV501 | HAUS5-002 | sense | 17 | 1920 | 45% | 37 |
| SIRV502 | HAUS5-003 | sense | 18 | 2014 | 46% | 38 |
| SIRV503 | HAUS5-004 | sense | 3 | 556 | 43% | 39 |
| SIRV504 | HAUS5-005 | sense | 1 | 2503 | 50% | 40 |
| SIRV505 | HAUS5-006 | sense | 16 | 2059 | 47% | 41 |
| SIRV506 | HAUS5-007 | sense | 2 | 582 | 51% | 42 |
| SIRV507 | HAUS5-008 | sense | 6 | 563 | 50% | 43 |
| SIRV508 | HAUS5-009 | sense | 17 | 2115 | 46% | 44 |
| SIRV509 | HAUS5-010 | sense | 4 | 915 | 47% | 45 |
| SIRV510 | HAUS5-201 | sense | 18 | 2504 | 48% | 46 |
| SIRV511 | no template | sense | 2 | 576 | 51% | 47 |
| SIRV512 | no template | antisense | 1 | 259 | 47% | 48 |
| SIRV6 family | | | | | | |
| SIRV601 | USF2-001 | sense | 9 | 1465 | 42% | 49 |
| SIRV602 | USF2-002 | sense | 8 | 604 | 41% | 50 |
| SIRV603 | USF2-003 | sense | 1 | 1999 | 35% | 51 |
| SIRV604 | USF2-004 | sense | 10 | 1567 | 43% | 52 |
| SIRV605 | USF2-005 | sense | 9 | 1118 | 43% | 53 |
| SIRV606 | USF2-006 | sense | 4 | 575 | 45% | 54 |
| SIRV607 | USF2-007 | sense | 4 | 604 | 47% | 55 |
| SIRV608 | USF2-008 | sense | 4 | 407 | 35% | 56 |
| SIRV609 | USF2-009 | sense | 4 | 515 | 48% | 57 |
| SIRV610 | USF2-010 | sense | 5 | 1193 | 39% | 58 |
| SIRV611 | USF2-012 | sense | 3 | 484 | 46% | 59 |
| SIRV612 | USF2-013 | sense | 10 | 1558 | 43% | 60 |
| SIRV613 | USF2-014 | sense | 6 | 1341 | 38% | 61 |
| SIRV614 | USF2-015 | sense | 5 | 489 | 40% | 62 |
| SIRV615 | USF2-016 | sense | 3 | 813 | 34% | 63 |
| SIRV616 | no template | sense | 4 | 561 | 45% | 64 |
| SIRV617 | no template | antisense | 1 | 306 | 43% | 65 |
| SIRV618 | no template | antisense | 1 | 219 | 41% | 66 |
| SIRV7 family | | | | | | |
| SIRV701 | TESK2-001 | sense | 5 | 2492 | 36% | 67 |
| SIRV702 | TESK2-002 | sense | 6 | 2277 | 37% | 68 |
| SIRV703 | TESK2-003 | sense | 5 | 2528 | 36% | 69 |
| SIRV704 | TESK2-004 | sense | 3 | 458 | 29% | 70 |
| SIRV705 | TESK2-201 | sense | 5 | 2492 | 36% | 71 |
| SIRV706 | TESK2-202 | sense | 5 | 979 | 33% | 72 |
| SIRV707 | TESK2-203 | sense | 10 | 2356 | 36% | 73 |
| SIRV708 | no template | sense | 5 | 919 | 33% | 74 |

TABLE 6

Selected features of the SIRVs (x indicates number of times the features are present)

| Name | AFE | TSS | A5SS | A3SS | CE | IR | TES | ALE |
|---|---|---|---|---|---|---|---|---|
| SIRV101 | | x | | | | | x | |
| SIRV102 | x | | | | | x | x | |
| SIRV103 | | | | x | | | | |
| SIRV104 | | x | | | | | | |
| SIRV105 | | x | | x | | | | x |
| SIRV106 | | x | x | x | | xx | | |
| SIRV107 | | | | | | | | |
| SIRV108 | | | | | | | | |
| SIRV109 | | | | | | | | |
| SIRV201 | | x | | xx | | | | |
| SIRV202 | | | x | xx | | | x | |
| SIRV203 | | x | | | x | | | x |
| SIRV204 | x | | | xxxxx | x | | | x |
| SIRV205 | | | | | | | | |
| SIRV206 | | | | | | | | |
| SIRV301 | | | | | x | x x | x | |
| SIRV302 | | x | | | xx | xx | | x |
| SIRV303 | | x | | | x | xx | | x |
| SIRV304 | | x | | | | | x | |
| SIRV305 | x | | | | | | | x |
| SIRV306 | | | | | x | x | | x |
| SIRV307 | | x | xx | | | | x | |
| SIRV308 | | | | | | | | |
| SIRV309 | | | | | | | | |
| SIRV310 | | | | | | | | |
| SIRV311 | | | | | | | | |
| SIRV401 | | x | xx | | x | x | | x |
| SIRV402 | x | | | | xx | | | x |
| SIRV403 | | | x | x | x | x | | x |
| SIRV404 | x | | x | | x | x | | x |
| SIRV405 | x | | | | x | x | | x |
| SIRV406 | x | | | | xx | x | x | |
| SIRV407 | x | | x | | x | x | | x |
| SIRV408 | | | xx | | x | | | x |
| SIRV409 | | | | | | | | |
| SIRV410 | | | | | | | | |
| SIRV501 | | x | | | x | | | x |
| SIRV502 | | x | | | | | | x |
| SIRV503 | x | | | | x | x | x | |
| SIRV504 | x | | | | x | | | |
| SIRV505 | | | | | x | x | | x |
| SIRV506 | | x | | | xx | xx | | x |
| SIRV507 | | x | | | xx | | | x |
| SIRV508 | | x | | | | x | | x |
| SIRV509 | x | | x | | x | | x | |
| SIRV510 | | x | | | x | | xx | x |
| SIRV511 | | | x | | xx | xx | | x |
| SIRV512 | | | | | | | | |
| SIRV601 | | | x | | x | | | x |
| SIRV602 | | x | x | | xx | | | |
| SIRV603 | x | | | | x | | x | |
| SIRV604 | | x | x | | x | | | x |
| SIRV605 | | x | x | | x | x | | x |
| SIRV606 | x | | x | | xx | | x | |
| SIRV607 | | x | | | x | x | | x |
| SIRV608 | x | | | | xx | | | x |
| SIRV609 | | x | | | xx | | | x |
| SIRV610 | x | | x | | xx | x | | x |
| SIRV611 | x | | | | x | x | | x |
| SIRV612 | | x | x | | x | x | | x |
| SIRV613 | x | | x | | xx | | | x |
| SIRV614 | x | | x | | x | | x | |
| SIRV615 | x | | | | x | | | x |
| SIRV616 | | | x | x | xx | | x | |
| SIRV617 | | | | | | x | | |
| SIRV618 | | | | | | | | |
| SIRV701 | | x | | | xx | | x | |
| SIRV702 | x | | | | xx | | | |
| SIRV703 | x | | | | xx | | | |
| SIRV704 | x | | | | xx | | | x |
| SIRV705 | | x | | | xx | x | | |
| SIRV706 | | | | | x | | | x |
| SIRV707 | x | | | | x | x | | |
| SIRV708 | | x | | | x | x | | x |

See also FIGS. 1, and 4 to 10.

For illustration purposes, the seven artificial SIRV genes (SIRV1-SIRV7) that give rise to the SIRV transcript families 1 to 7 are listed SEQ ID NOs: 149-156. The SIRV genes are only defined by their exon sequences (i.e. the sequences that are exons in at least one of the transcripts, they can be introns, i.e. not present, for other transcripts), as they are defined by the transcripts they give rise to. As mentioned herein, it is sufficient if they exist merely as a concept.

The exons of the SIRVs are listed in SEQ ID NOs: 156-334.

SIRVs lack identity with entries in the NCBI database as revealed by blast searches on the nucleotide and on the protein level. In an in silico experiment generating 50 nt long NGS reads from the artificial SIRV transcriptome, the SIRVome, also did not align significantly to annotated transcriptomes from model organisms Human, Mouse, *Arabidopsis thaliana, C. elegans, D. Melanogaster, E. Coli* (CGA1.20), *S. Cerevisiae* and *X. tropicalis*, but mapped very well to the SIRVome. In addition, any off-target alignments can be easily identified as read spikes. It is therefore concluded that the SIRV transcripts would be highly distinct from the model organism transcripts tested and are unlikely to interfere with transcript discovery and quantification when used as spike-in controls in these genomes. By extrapolation, and because genomes from many different systemic classes were tested in addition to the nt blast, it can be reasonably assumed that the artificial SIRV sequences would not interfere with any known genomic system.

SIRVs can also be used in conjunction with ERCCs since off-target mapping to ERCC spike-in transcripts was almost absent.

The 74 SIRV transcripts
- can be used as spike-in transcripts in NGS RNA-Seq experiments and other NA analysis methods such as micro-array analysis or qPCR,
- are artificial sequences allowing for unique mapping to SIRVome with very low off-target alignments,
- mimic natural mRNAs regarding length, GC content, intron splice site dinucleotides and exon-intron structures,
- can be used in conjunction with ERCCs,
- can be produced cost-effectively as T7 RNA polymerase transcripts.

The SIRVs allow for
- poly(A) based selection and amplification,
- isoform detection,
- annotation-based isoform mapping and hypothesis building,
- isoform abundance estimation,
- log-fold change validation (by using 2 mixes with varying SIRV concentrations),
- training and validation of isoform abundance estimation algorithms,
- isoform de novo assembly,
- isoform segregation in a SQUARE system (complexity reduction method described in WO 2011/095501 A1).

Example 2: SIRV Production

To produce the SIRVs, in vitro transcription templates were synthesized by an external DNA synthesis provider. These constructs comprise 5' to 3' (a) a unique restriction site (XhoI), immediately upstream of (b) a T7 RNA polymerase promoter, whose 3' G is the first nucleotide of (c) the SIRV sequence, seamlessly followed by (d) a A(30) tail that is fused with (e) an exclusive NsiI restriction site (FIG. 11).

The fusion of the T7 promoter as well as the integration of the NsiI site into the A(30) tail allows for a transcription that yields sequence-true RNA starting with a 5' G (part of the SIRV sequence as well as of the T7 promoter) and ending with the poly(A) tail without extra 3' nucleotides.

A DNA synthesis provider delivered the gene cassettes cloned into a vector, the plasmid pUC57 without intrinsic T7 promoter. The plasmid pUC57, 2710 bp in length, is a derivative of pUC19 and commonly used as a cloning vector in *E. coli*. The vector contains a bla gene for ampicillin resistance and a lacZ gene for white/blue selection. GenBank accession No Y14837.1, map provided by Bio Basic, Inc.

8-10 μg of each vector were received which is sufficient for restriction and transcription assays. Double digestion with XhoI and NsiI shows a correct insert size and completion of restriction.

However, for large scale preparative transcription, the SIRV plasmids were produced at a 50 μg batch scale.

Plasmid linearization: The initial default method to produce large quantities of RNA is run-off transcription of the NsiI restricted vector containing the SIRV expression cassette. For this, a few μg of the plasmid were digested to obtain a precise 3' end. While complete PstI/NsiI restriction has already been shown by Bio Basic for all constructs, we examined efficient cleavage by NsiI alone (cf. FIG. 2), since initiation of transcription is one of the limiting steps of in vitro transcription reactions, and even a small amount of circular plasmid in a template prep will generate a large proportion of transcripts.

NsiI restriction produces a 3'-protruding end. This might initiate second strand transcription, in which case we resorted to blunting the sticky. For this, the 3'-5' exonuclease activity of T4 DNA polymerase was used.

T7 transcription using Epicentre AmpliScribe Kits High Yield and Flash: The linearized transcripts were used as templates in commercial T7 transcript kits, Epicenter's AmpliScribe T7 High Yield Transcription Kit (Art. No 150408) and AmpliScribe T7 Flash Transcription Kit (Art. No 150405).

The major factors governing T7 transcription are the use of a kit with transcription conditions tolerating high dNTP concentrations. This allows for a high yield, i.e. 1 μg plasmid can produce up to 160-180 μg RNA (e.g. Epicentre's High Yield kit).

Furthermore, up to the absolute limit, more template will produce more RNA. For templates of varying length, the molarities have to be taken into account, short templates will not produce the same mass of RNA as longer ones since transcription initiation is the limiting step, and one phase of T7 polymerase extension covers up to 600 nt (info from Epicentre's web-site).

Longer incubation times are increasing the initiation likelihood, with a greater effect on the yield of shorter templates. Hence it is sometimes recommended to incubate not for the standard 2 hours but for 4-6 hours or even over-night. Longer incubation however, can result in RNA degradation since the T7 transcription buffer contains $Mg^{2+}$ cations.

Figure 3:
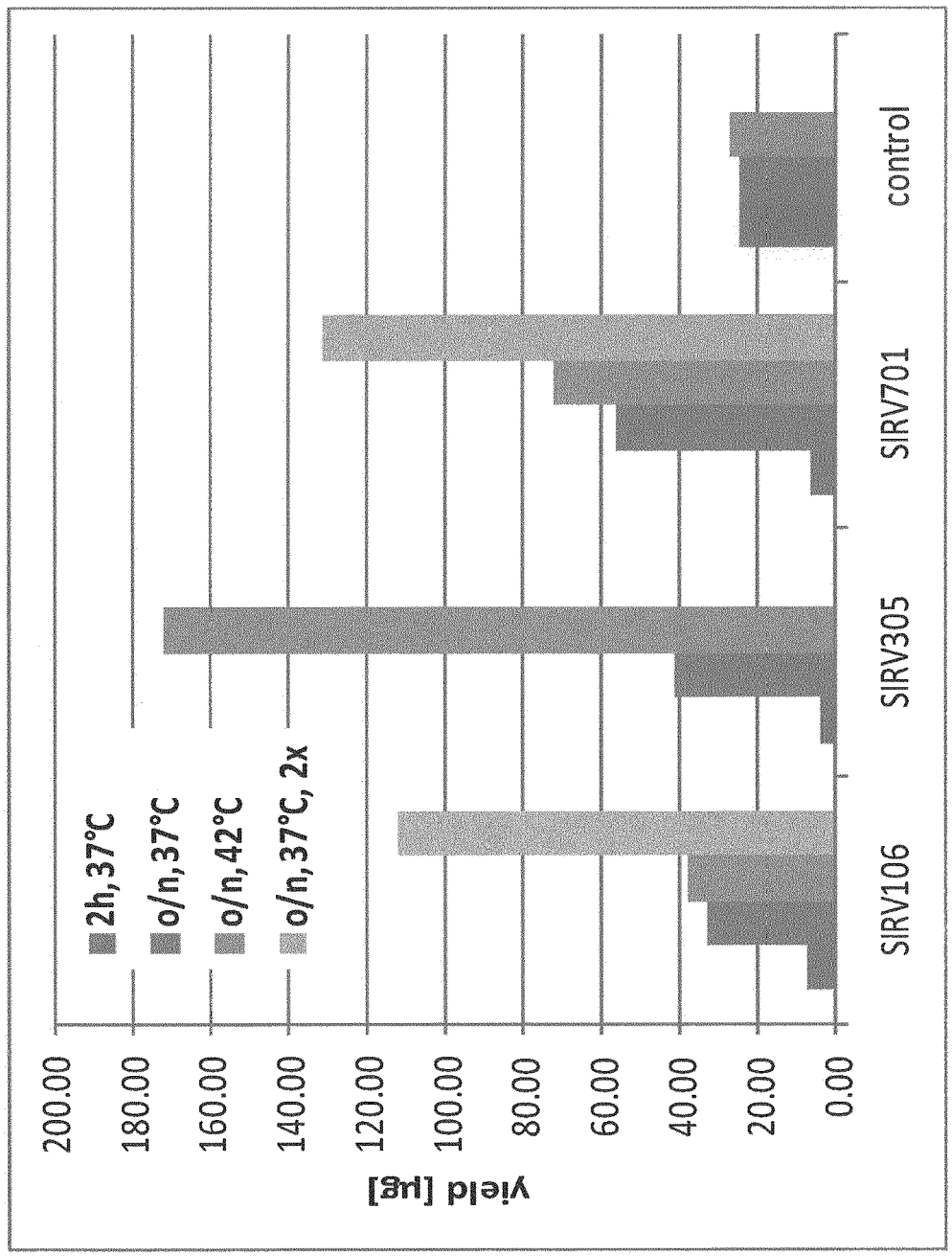
FIG. 3: Exemplary results for yields of transcription by T7 polymerase, for selected SIRVs and conditions. Transcription was successful for most of the selected conditions overnight (o/n).
Figure 4:
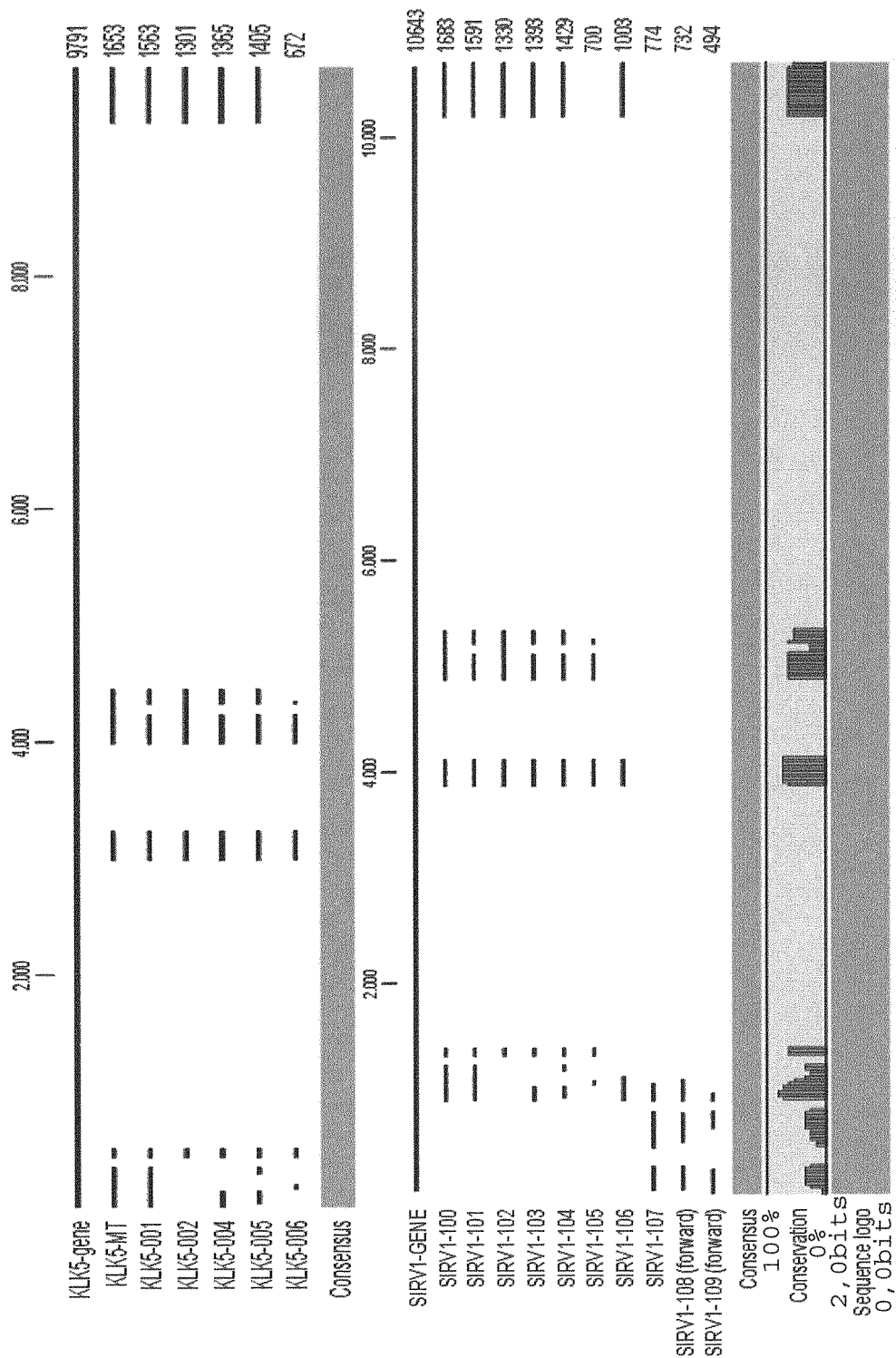
FIG. 4: KLK5 and SIRV1 family alignment. The illustration shows the transcript alignments of SIRV1 and the corresponding reference gene. Note that SIRV1-100 is the master transcript. SIRV1-101-105 are the canonical transcripts (in analogy to the KLK5 transcripts). Transcripts SIRV1-106-109 are artificial transcripts whereby the latter three are over-lapping (antisense) transcripts. MT=Master transcript.
Figure 5:
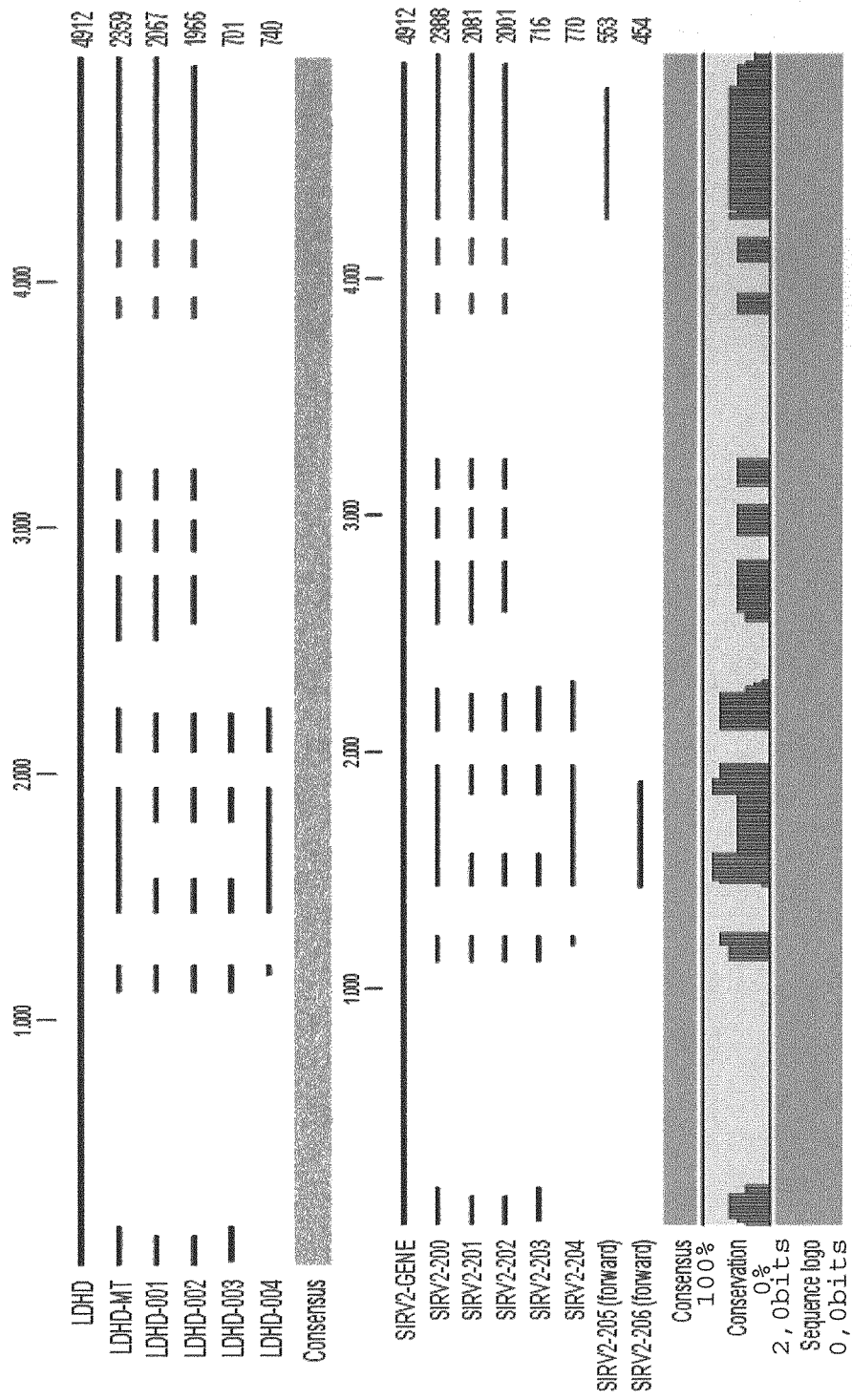
FIG. 5: LDHD and SIRV2 family alignment. The illustration shows the transcript alignments of SIRV2 and the corresponding reference gene. Note that SIRV2-100 is the master transcript. SIRV2-201-204 are the canonical transcripts (in analogy to the LDHD transcripts). Transcripts SIRV2-205 and 206 are artificial monoexonic antisense. MT=Master transcript.
Figure 6:
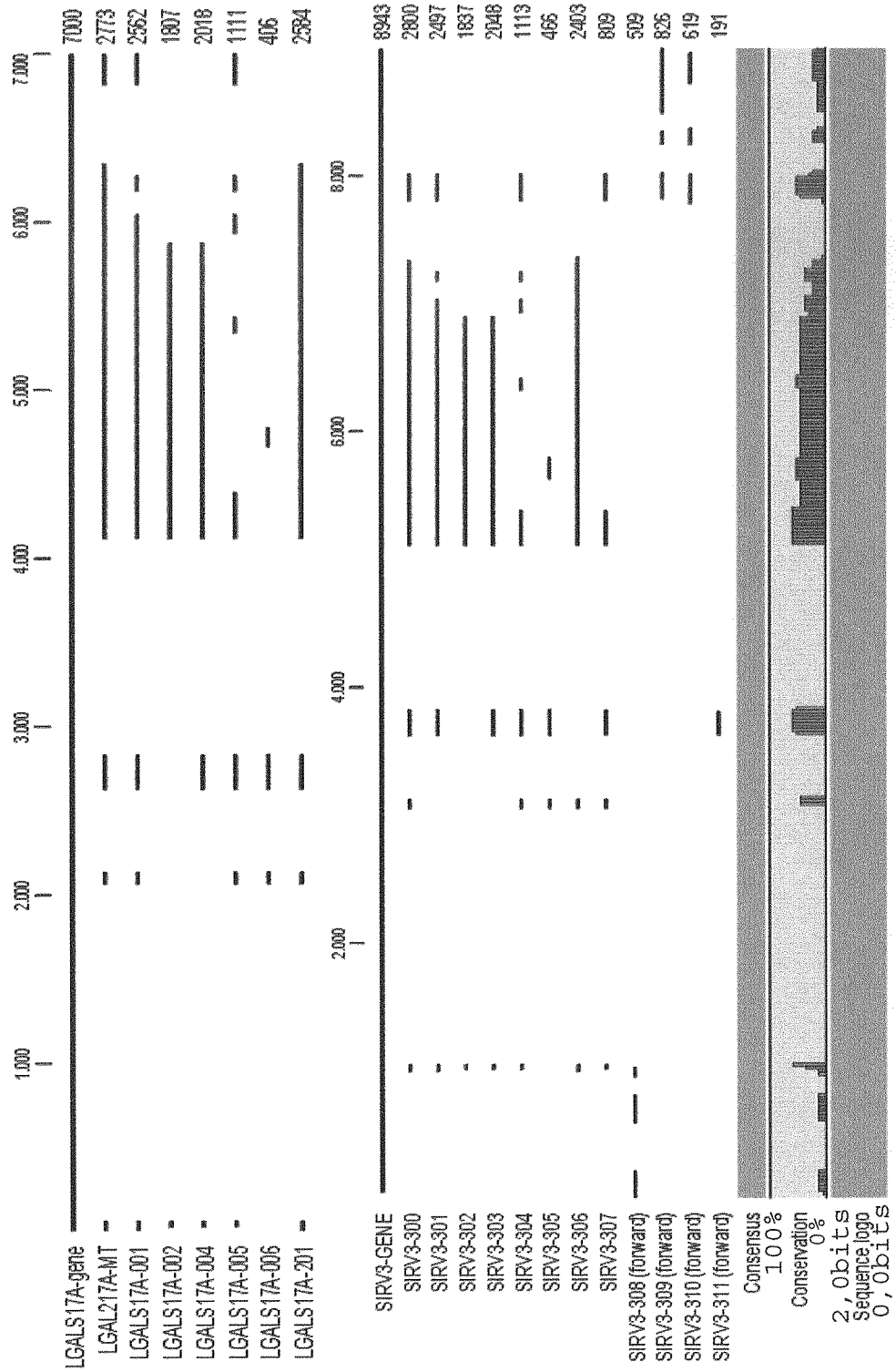
FIG. 6: LGALS17A and SIRV3 family alignment. The illustration shows the transcript alignments of SIRV3 and the corresponding reference gene. Note that SIRV3-100 is the master transcript. SIRV3-301-306 are the canonical transcripts (in analogy to the LGALS17A transcripts). Transcripts SIRV3-307-311 are artificial transcripts whereby the latter one is a monoexonic antisense transcript. Transcripts SIRV3-308-310 are overlapping antisense transcripts. MT=Master transcript.
Figure 7:
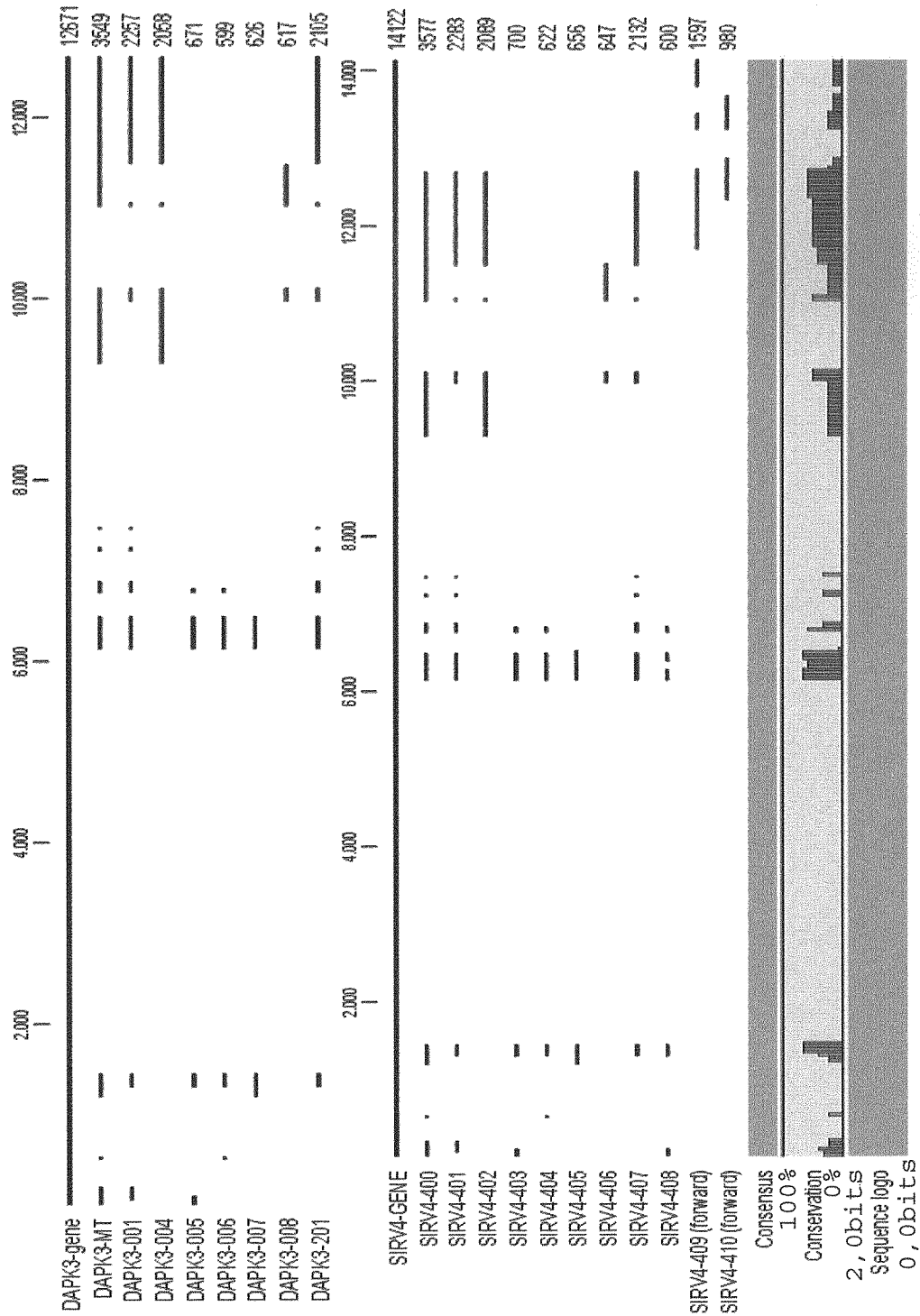
FIG. 7: DAPK3 and SIRV4 family alignment. The illustration shows the transcript alignments of SIRV4 and the corresponding reference gene. Note that SIRV4-100 is the master transcript. SIRV4-401-407 are the canonical transcripts (in analogy to the DAPK3 transcripts). Transcripts SIRV4-408-410 are artificial transcripts whereby the latter two are overlapping antisense transcripts. MT=Master transcript.
Figure 8:
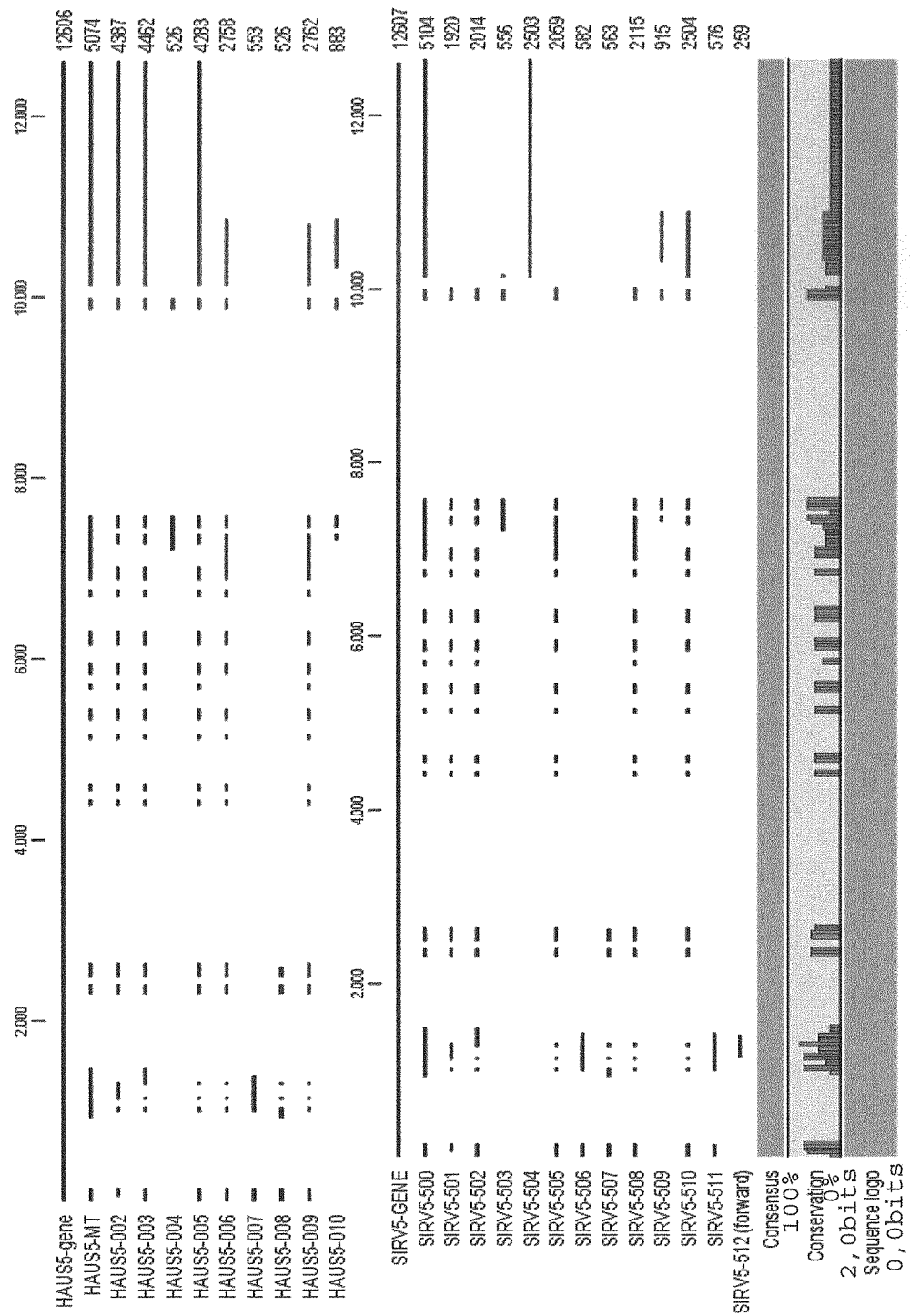
FIG. 8: HAUS5 and SIRV5 family alignment. The illustration shows the transcript alignments of SIRV5 and the corresponding reference gene. Note that SIRV5-100 is the master transcript. SIRV5-501-510 are the canonical transcripts (in analogy to the HAUS5 HAUS transcripts). Transcripts SIRV5-511 and 512 are artificial transcripts whereby the latter one is a monoexonic antisense transcript. MT=Master transcript.
Figure 9:
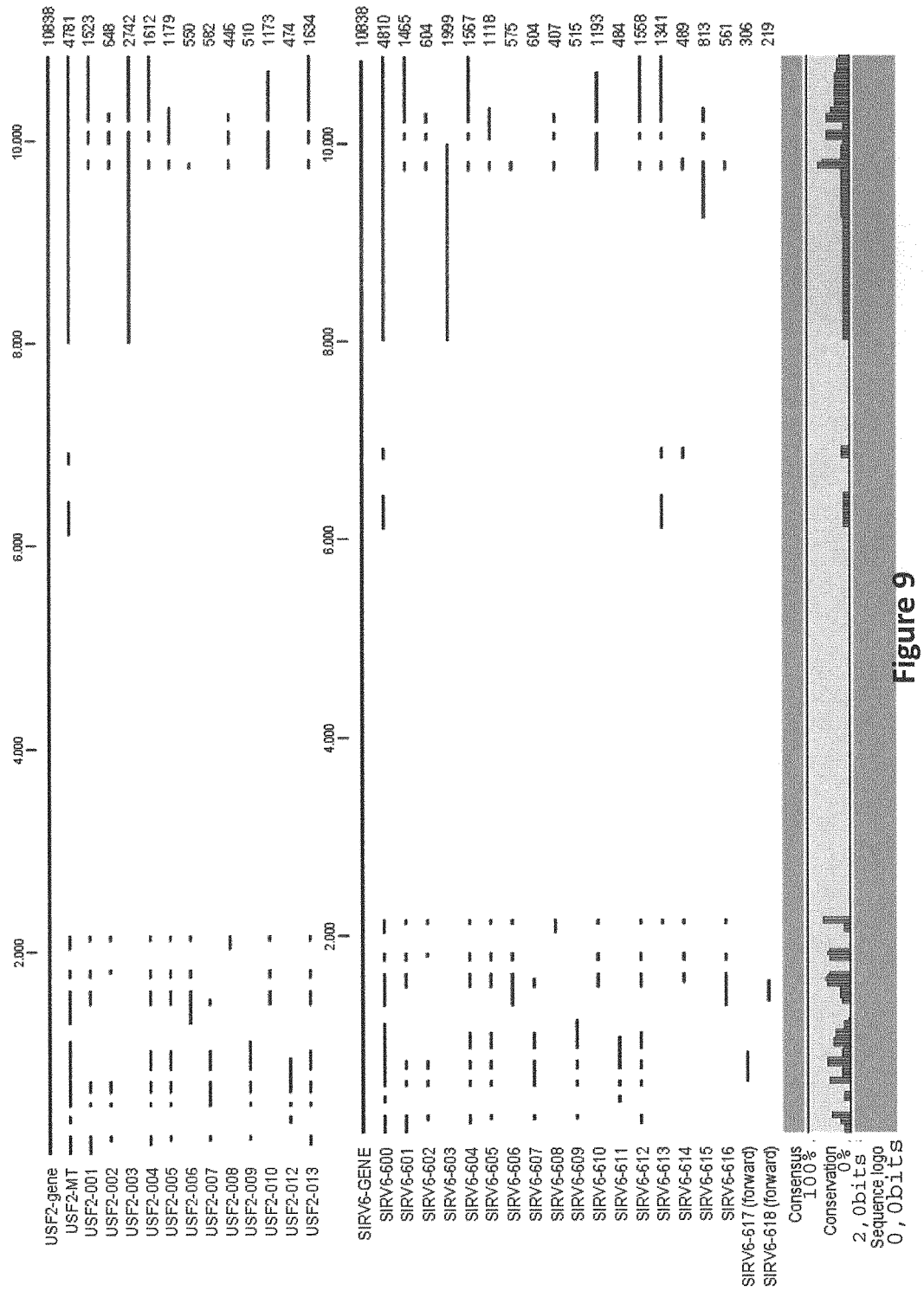
FIG. 9: USF2 and SIRV6 family alignment. The illustration shows the transcript alignments of SIRV6 and the corresponding reference gene. Note that SIRV6-100 is the master transcript. SIRV6-601-615 are the canonical transcripts (in analogy to the USF2 transcripts). Transcripts SIRV6-616-618 are artificial transcripts whereby the latter two are monoexonic antisense transcripts. MT=Master transcript.
Figure 10:
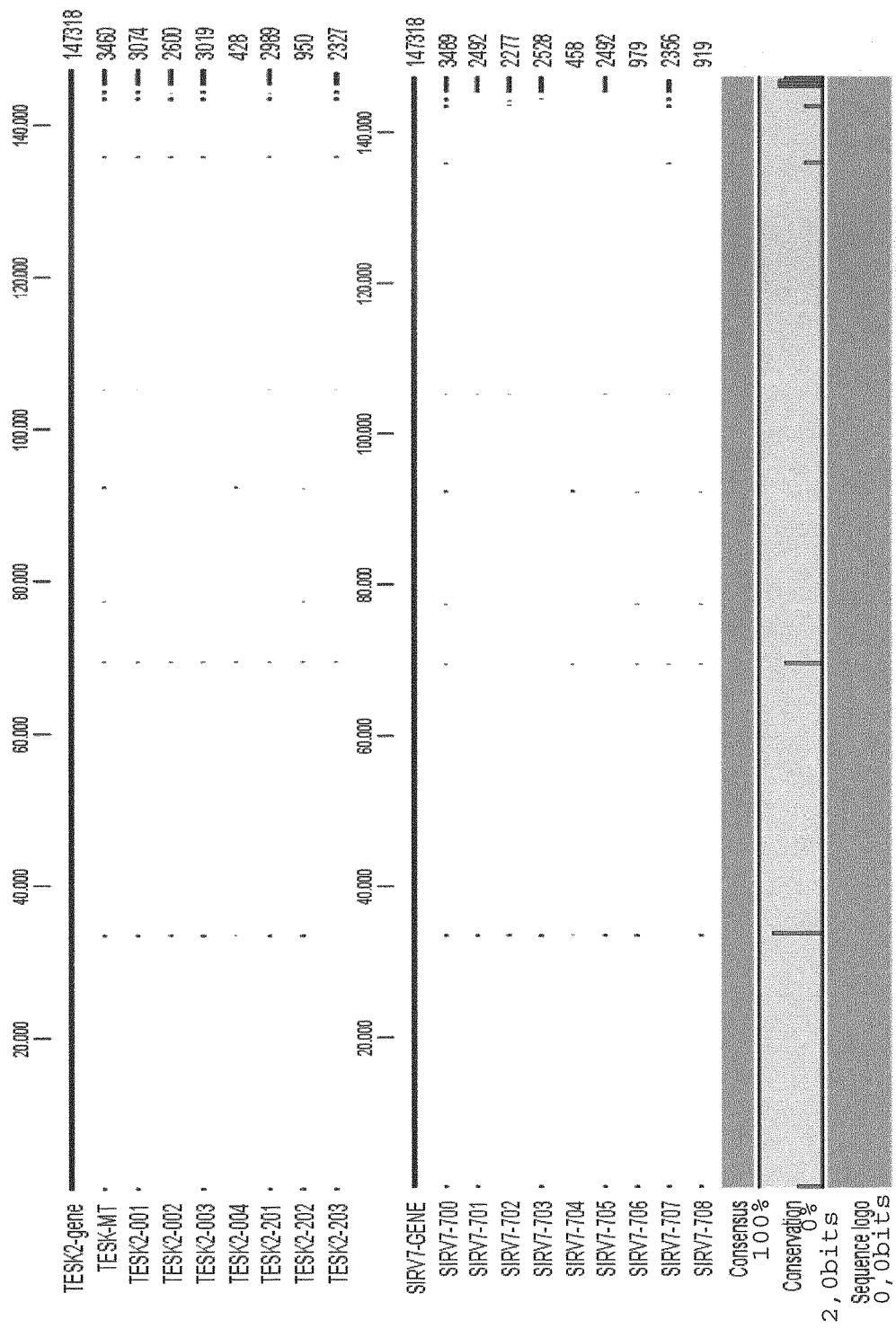
FIG. 10: TESK2 and SIRV7 family alignment. The illustration shows the transcript alignments of SIRV7 and the corresponding reference gene. Note that SIRV7-100 is the master transcript. SIRV7-701-707 are the canonical transcripts (in analogy to the TESK2 transcripts). Transcripts SIRV7-708 is an artificial transcript. MT=Master transcript.

Increasing the T7 transcriptase reaction temperature from 37° C. to 42° C. can result in a strong increase in yield. This might be more pronounced for more complex (GC-rich, structured) templates (cf. FIG. 3).

Trace amounts of GuSCN, phenol, SDS, RNA or metal ions can inhibit T7 transcriptase activity. A rigorous purification of the linearized plasmid, e.g. by Whatman purification is recommended. Alternatively, the reaction volume can be increased or the plasmid input volume be lowered.

Template DNA should be removed by DNase. According to Epicentre (AmpliScribe manual), 1 unit of the included DNase can be added directly to the transcription with further incubation for 15 min. at 37° C. The DNase treatment will be tested for affecting RNA integrity, i.e. if it degrades RNA due to residual RNases. Alternatively, DNA can be removed by acidic phenol extraction, also in the SPLIT protocol variant. However, GuSCN might not be needed for subsequent silica column binding.

Remaining plasmid DNA might be detected in Bioanalyzer runs (even with RNA-specific dyes) or—quantitatively—in qPCR assays using primers GCTAATACGACTCACTATA*G (SEQ ID N: 337) and TTTTTTTTTTTTTTTTTTTTTTTTT*V (SEQ ID NO: 338), with (*) being nucleotides with a phosphothioate linkage.

Recommended SIRV purification methods are described in the following. PAGE: The standard protocol to purify in vitro transcribed RNA with the high quality needed for NGS spike-in transcripts is PAGE elution, but is cumbersome, not very precise, might induce UV crosslinks, and it is not suitable for transcripts >1 kb.

Silica-based purification: Purification will initially be made only by Whatman protocol known to all skilled in the art removing dNTPs, additives and proteins from the nucleic acids. However, this procedure is loss-prone; up to 60% of a test marker was not eluted in the standard procedure. In addition, the DNA template will co-elute. Whether elution buffer EB or storage buffer SB can be used for efficient elution should be tested.

Magnetic oligo(dT) bead purification of transcripts: When transcription reactions fail to produce full-length RNA (up to the NsiI restriction site), then this RNA will not contain the A(30)-tail. Hence, oligo(dT) bead purification can be used to selectively purify full-length transcripts. This method, however, will not discriminate against aberrant RNAs produced by run-through transcription or second strand transcription since these RNA also contain min. one copy of the A(30)-stretch. Note that one strand of the DNA template will also contain the poly(A) stretch. It needs to be determined whether DNA is present in its dsDNA form (since the transcript is released from its template) and cannot participate in oligo(dT) hybridization. In one variation of this method the oligo would be RNA, and the binding step could be followed by an RNase H digestion, removing any plasmid DNA that bound to the beads via its encoded A(30) stretch. Alternatively, the DNA is removed by DNase treatment.

Pippin prep: The Sage Scientific Pippin prep is an automated gel elution system, which is designed for elution of dsDNA (e.g. NGS libraries) from 1.5% or 2% native agarose cassettes. Since RNA will not run according to the Pippin prep's external or internal DNA standard, no length estimation is possible. Nevertheless, the SIRVs of sufficient purity run in a single, major peak, which can be detected with the size selection protocol "Peak", automatically collecting the next peak after a set threshold base pair value.

Quality control and quantification is important to produse SIRV mixtures. Nanodrop quantification: Photometric measurements give the concentration (and thus, yield) and the purity in the form of A260/A230 and A260/A280 ratios. Important, insufficient purification are problematic as absorbance measurements as done in the Nanodrop instrument (Nanodrop Instruments) measure also trace amounts of dNTPs, which have an over-proportional absorbance at 260 nm. Qubit measurements (LifeTechnologies) could be taken as a third reference.

Agilent Bioanalyzer RNA Nano chip: The SIRV transcripts can be assessed on an Agilent Bioanalyzer RNA chip for correct length, quantity, RNA integrity (i.e. break-off or degradation products) and aberrant (longer) products.

Denaturing gel electrophoresis: Complementary to the Bioanalyzer, the RNAs can also be analyzed on denaturing PAA or agarose gels, depending on their size. This might enable a more accurate assessment of transcript lengths but without quantification and the range provided by the Bioanalyzer.

qPCR: To assess the spike-in transcripts' integrity and to derive a complementary quantification, full-length cDNA synthesis can be followed by qPCR of multiple amplicons, positioned in the 5', middle and 3' region of the transcript. As an external standard, the PCR transcription template can be amplified in the same set-up. These set-ups are also applicable to determine the relative concentrations in SIRVs mixes.

These SIRV-specific primers need to be designed carefully to target only one specific SIRV each and not e.g. exons common to all SIRVs of a given gene.

Example 3: Use of SIRVs as External Control in RNA-seq

It is widely assumed that an experimental procedure consisting of the following steps i) sample collection, ii) RNA purification, iii) NGS library generation, iv) NGS sequencing, v) read aligning to a reference annotation and vi) subsequent bioinformatical processing calculates accurately relative transcript abundances. However, different methods, e.g. different sample preparations but also bioinformatical processing routines of the same experimental data set as we show in the following example are also possible.

Only very few data sets are available which contain partially validated transcript abundances. One of those is from Microarray Quality Control (MAQC) samples (MAQC Consortium, 2006) and contains universal human reference RNA (UHRR) and human brain reference RNA (HBRR). For both RNA samples qPCR measurements were derived with 1044 Taqman probes. These measurements are available from the Gene Expression Omnibus under accession number GSE5350. In addition, the UHR and brain RNA samples were sequenced on seven lanes of an Illumina GenomeAnalyzer, yielding 35 bp single-end reads (James et al., 2010). These reads, which are available from the NCBI Read Archive under accession number SRA010153, were mapped with TopHat2 to Ensembl annotation GRCh37 version 75. From the 1044 Taqman probes only the 906 probes were retained, which, according to GSE5350, map to a single Refseq annotation. Since the Ensembl annotation was used in the experiments this set of Taqman probes was further reduced by requiring the Refseq annotation of a Taqman probe to have a unique equivalent in Ensembl. Finally, from these 894 Taqman probes only those were used whose Ensembl transcript annotation was contained within a gene having multiple transcripts. This resulted in a final set of 798 Taqman probes. Pennseq (Hu et al., 2014), method 1, and Cufflinks with and without bias correction, methods 2 and 3, (Roberts et al., 2011; Trapnell et al., 2010) were used to derive concentration estimates in the form of FPKM values on the 798 transcripts.

The correlation between the FPKM values obtained by the different methods and the qPCR values are shown in Table 7. The correlation is measured with the $R^2$ value and the Spearman correlation ρ in log space. Since values close to zero can significantly distort statistics in log space FPKM values below 1e-3 are set to 1e-3 for all the methods.

Alternatively, transcripts with an FPKM below 1e-3 can be considered not to be detected.

TABLE 7

Correlation between FPKM and qPCR and properties of not detected (ND) transcripts, i.e. transcripts with FPKM <1e-3, on UHR RNA lane SRR037445.

|  | $R^2$ | ρ | ND % | ND avg $\log_{10}$ (qPCR) |
| --- | --- | --- | --- | --- |
| Pennseq | 0.418 | 0.7129 | 2.79 | −1.6506 |
| Cufflinks | 0.3317 | 0.6541 | 15.48 | −1.6801 |
| Cufflinks with bias correction | 0.3943 | 0.7312 | 14.61 | −1.7606 |

As shown in Table 7, the $R^2$ value is on one hand 0.418 for Pennseq, 0.3317 for Cufflinks without bias correction and 0.3943 for Cufflinks with bias correction. On the other hand, the Spearman correlation is 0.7129 for Pennseq, 0.6541 for Cufflinks without bias correction and 0.7312 for Cufflinks with bias correction. Strikingly, Cufflinks with and without bias correction does not detect 14.61% and 15.48% of the transcripts which were shown to be present by qPCR, while Pennseq do not detect 2.79%, respectively. Important, the transcripts which have not determined by the 3 calculation methods have had a high average $\log_{10}$ abundance of −1.65 to −1.76 in the qPCR validation experiments.

The example demonstrates through a selection of 798 Taqman qPCR validated gene loci which contain more than one Ensembl transcript annotation that two different bioinformatical algorithms, and one with two different bias corrections (Cufflinks), produce three significantly different results. The alignments distribute the reads within a high number of genes to the wrong transcripts. Absolute correlations are impossible because the ground trough us unknown. Only artificial transcript variants of known abundances which are present in similar complex settings as transcripts in naturally occurring genes enable a quantitative evaluation of precision of measurement methods, be it individual steps and entire workflows.

Example 4: Chi-Squared Test for Testing Random Distribution

By way of example, it shall be explained on how to apply the chi-squared test to "the set of the artificial transcript sequences having essentially randomly distributed occurrences of 5' start trinucleotides selected from GAA, GAC, GAG, GAT, GCA, GCC, GCG, GCT, GGA, GGC, GGG, GGT, GTA, GTC, GTG, GTT".

```
Number of distinct cases, or cells (n): 16
(GAA, GAC, GAG, GAT,GCA, GCC, GCG, GCT,
GGA, GGC, GGG, GGT, GTA, GTC, GTG, GTT)

Number of artificial transcript sequences (N): 74
Occurrences (counts) of 5' start nucleotides
(O₁, O₂, O₃, . . ., Oₙ):
GAA 5 GAC 5 GAG 4 GAG 6 GAT 3 GCA 2
GCC 4 GCG 5 GCT 6 GGA 7 GGC 4 GGG 3
GTA 4 GTC 5 GTG 6 GTT 5

Degrees of freedom (df):
n - p = 15 (p = 1 for a discrete uniform
distribution)
```

The expected occurrence for any cell is (under the null hypothesis of a discrete uniform distribution): $E_1=N/n=4.625$. This means a set having a (perfect) uniform distribution of trinucleotides would, fictitiously, have 4.625 of each of the mentioned trinucleotides as 5' start trinucleotides Chi-square (Pearson's cumulative test statistic) is defined as:

$$\chi^2 = \sum_{i=1}^{n} \frac{(O_i - E_i)^2}{E_i}$$

The above values for $O_1$, $E_1$ and n applied to the formula directly above yield: Chi-square=5.57

Probability values ("p value") for a certain Chi-square value (5.57 in this example) and certain degrees of freedom (15 in this example) are tabulated in well-known tables (so-called Chi-square tables). The p value can also be calculated by widely-used office software such as Microsoft Excel, LibreOffice or OpenOffice (the two latter of them being freely available), or with the freely available R software package. In the English-language version of Microsoft Excel 2003, this function is called CHIDIST.

The p value associated with Chi-square=5.57 and df=15 is 0.9861. Therefore, the occurrences of start nucleotides in this example satisfy the condition of being "essentially randomly distributed" as defined herein.

Example 5: SIRV Evaluation 60 of the 74 SIRVs from the above described set given by SEQ ID no 1-74 have been synthesized, cloned, expressed, purified, quality controlled and determined in their concentrations through electrophoretic measurements (RNA nano and pico chips and assays in Bioanalyzer, Agilent) before being combined into two master mixes and concentrated to the concentrations above 10 ng/μl for further sample preparations. SIRV Mix 1 contained all 60 SIRVs in equal masses. SIRV Mix 2 was prepared according to a mixing scheme which varied the amount of individual SIRVs whitin a SIRV gene by up to 2 orders of magnitude in randomized ratios of 1:10:100. In this SIRV Mix 2 each SIRV gene as sum of all subsidiaries SIRVs were provided in equal masses.

Three RNA samples were prepared. Sample 1 contained only the generic SIRV transcript mixture SIRV Mix 1 (100 ng). Sample 2 combined 500 ng universal human reference RNA (Agilent) with 0.3 ng ERCC (Ambion) and 3 ng SIRV Mix 1. Sample 3 consisted of 500 ng universal human reference RNA (Agilent) with 0.3 ng ERCC (Ambion) and 3 ng SIRV Mix 2.

The three mRNA samples were shipped to a service provider (Fasteris, Suisse), who made the samples preparations and carried out the sequencing. NGS libraries were prepared from Sample 1 by a custom library preparation without polyA selection, while samples 2 and 3 underwent an Illumina stranded mRNA library preparation with polyA selection. All three libraries were barcoded, mixed in attempted equal ratios. Sequencing was performed on an Illumina MiSeq with v3 chemicals and resulted in 150 bp indexed reads.

In total, 26.7 Mio reads were generated and assignable to the given barcodes. The quality of the reads was assessed with FastQC (v0.11.1). Some adapter contamination was detected and could be trimmed by using bbduk from the bbmap suite (version 32.32) with the following parameter: ./bbduk.sh . . . ktrim=r k=28 mink=12 hdist=1 minlength=20. The resulting reads were mapped with tophat (v.2.0.8) against the combined transcriptomic and genomic reference annotation of Ensembl's GRCh 37.75, Ambion's ERCC92, and the SIRVome. The mapping statistics are shown in Table 8.

TABLE 8

Mapping statistics.

|  | Total reads | Mapping reads | [%] | Uniquely mapping reads | [%] |
|---|---|---|---|---|---|
| Sample 1 | 10,246,442 | 8,585,641 | 83.79 | 8,505,344 | 83.01 |
| Sample 2 | 10,119,416 | 8,642,852 | 85.41 | 8,399,336 | 83.00 |
| Sample 3 | 6,308,855 | 5,404,486 | 85.67 | 5,268,757 | 83.51 |

The distribution of the uniquely mapping reads over the different annotations is given in Table 9. In sample 2 and sample 3 the following read ratios UHRR:ERCC:SIRV of 70.3:2.7:27 were expected according to the weight input and assuming 2% mRNA content in the total RNA.

TABLE 9

Distribution of the uniquely mapping reads.

|  | GRCh37.75 |  | ERCC92 |  | SIRV |  |
|---|---|---|---|---|---|---|
| Sample 1 | 4,330 | 0.05% | 11 | 0.00% | 8,505,555 | 99.949% |
| Sample 2 | 7,521,308 | 89.55% | 38,031 | 0.45% | 839,997 | 10.00% |
| Sample 3 | 4,156,399 | 78.89% | 22,207 | 0.42% | 1,090,151 | 20.69% |

In Sample 1, the exceptionally high number of 99.94% of all reads mapped to the SIRVome whereas only 0.06% mapped to the entirety of the human genome and the ERCCs. This result proves the high incompatibility of the SIRVome with other known sequences and the uniqueness of the SIRV sequences.

In Samples 2 and 3, 58 and 52 of the 92 ERCCs were detected corresponding to 0.45 and 0.42% of all reads. The recurring under-representation of the ERCC reads below the added 3% by weight is due to the relative short poly(A) tails of 24 adenosines only and the potentially hydrolyzed or otherwise fragmented and poly(A) selected and depleted ERCCs. The SIRVs were mixed into the sample with a 10-fold access over the ERCCs and came out with 10 and 20.7% and therefore 20- to 40-fold access which is caused by the longer poly-A tails of 30 adenosines and potentially higher integrity of the SRIVs.

The mapped reads were visually inspected using the IGV genome browser. Cufflinks (v. 1.3.0) with bias correction was used to assess the transcript abundances. All SIRV transcripts were detected with FPKM values >0. The input-output correlations with $R^2$ values below 0.8 proved that extensive quality measures are required to validate ground trough input concentrations by several independent means beside preliminary stock concentration measures using intercalating fluorescence dyes. qPCR and Taqman assays are being prepared for respective validations of the concentration.

Figure 12:
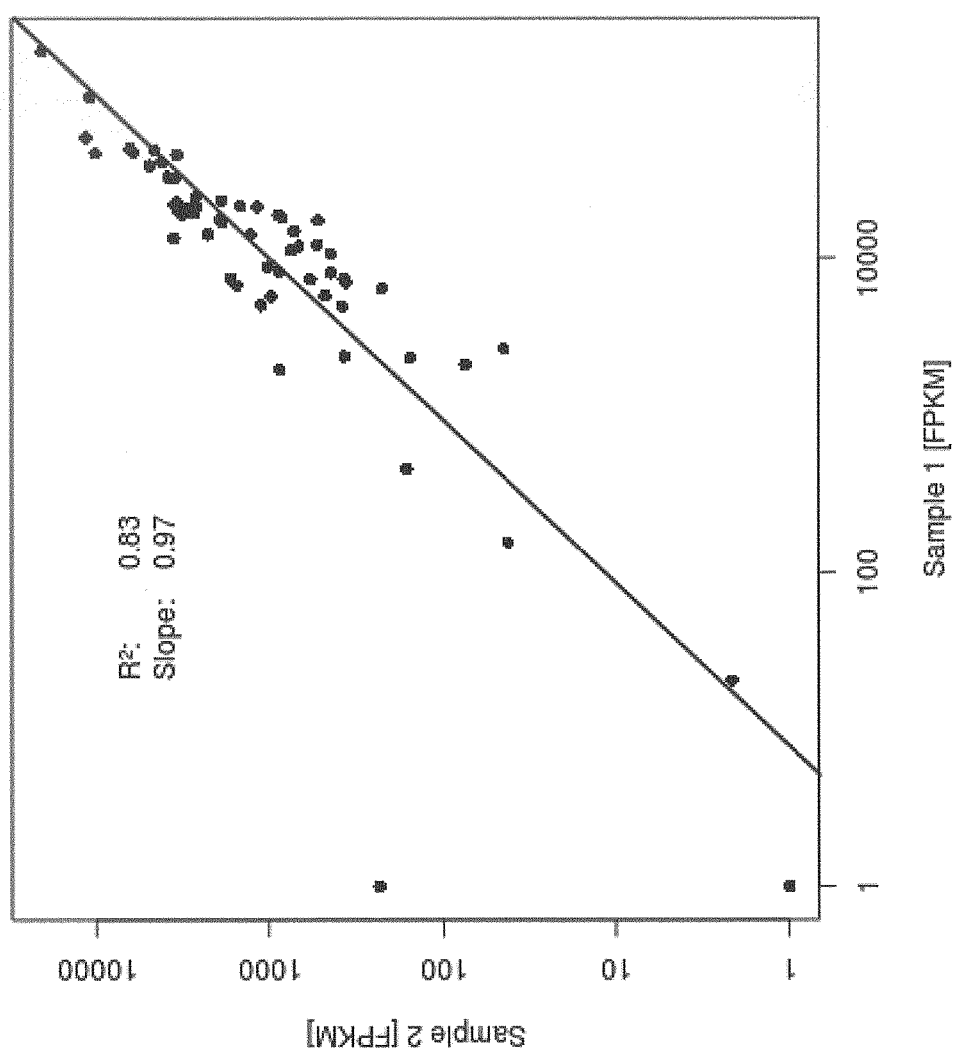
FIG. 12: FPKM correlation plots. The FPKM values of Sample 1 and Sample 2 are plotted against each other.

FIG. 12 shows the correlation of by Cufflinks calculated relative concentration values of Sample 2 vs. Sample 1. The SIRV concentrations of Sample 2 are of course app. 10 times lower due to the UHRR and ERCC background. Nevertheless, high $R^2$ values above 0.95 would have been expected because the identical SIRV Mix 1 was measured in both samples. The partially false read assignments are caused by the bioinformatical processing as shown FIG. 13.

Figure 13:
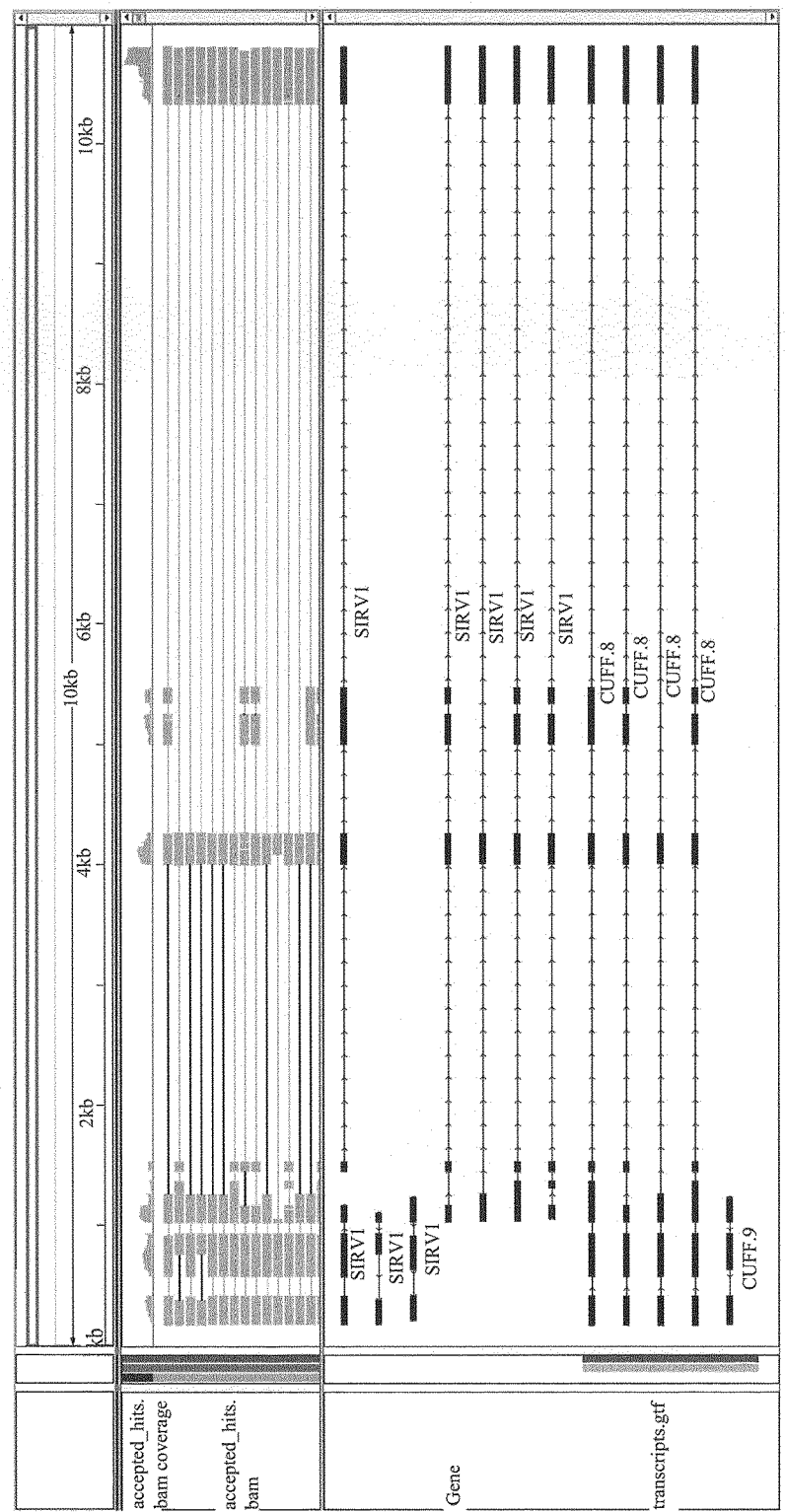
FIG. 13: Genome browser screen shot showing the coverage of the artificial gene SIRV 1. All with SIRV 1 labeled transcripts correspond to the given annotation. Cufflinks derives additionally five transcript variants named Cuff 8 and 0.9, which introduces errors.

The overall coverage for SIRV gene 1 is shown in the top row FIG. 13 together with the identified annotated transcripts SIRV 101 to 109 (all encoded with SIRV1) below, except 105 which was not part of the 60 out of 74 SIRVs in SIRV Mix 1 and hence not included in the annotation. Because Cufflinks added additional transcript hypotheses and assigned reads to the set of a transcript variants following internally defined length dependent probability distributions and other numerous assignment rules the presented values are simply not correct as the SIRV correlation between Sample 1 and 2 with an $R^2$ value of 0.83 is low for identical samples.

For the evaluation of the made assignment errors it is essential to know the ground trough of the input concentrations which is only possible with the presented SIRV reference set. Only the analysis of the input-output correlation in the given model complexity allow to extrapolate assumptions about the accuracy of the measurements to the full set of unknown transcript variants, which is made possible for the first time by the present invention.

Example 6: Preparation of SIRV Mixes E0, E1, and E2 with Defined Concentrations and Concentration Ratios, and Use of the SIRV Mixes to Spike RNA Samples RC-0, RC-1 and RC-2

Here, 69 SIRVs from the 74 SIRVs were chosen which had been obtained with a purity as defined by displaying 85 w/w % in the main peak of the correct calculated size in the capillary electrophoresis Bioanalyzer trace.

The SIRV solutions were measured by absorbance spectroscopy (Nanodrop, Thermo Scientific) and the stock solution concentrations were adjusted to 50 ng/μl. The ratios of absorbance at 260 nm to 280 nm and 260 nm to 230 nm indicate highest purity of the RNA and were recorded as follows:

$$A_{260\ nm/280\ nm}\ 2.14 \pm 0.12,$$

$$A_{260\ nm/280\ nm}\ 2.17 \pm 0.20$$

The Nanodrop allows for precise RNA quantification, error according to the manufacturer's specification is ±2 ng/μl for nucleic acid samples ≤100 ng/μl. The relative error for the quantification of the final SIRV stock solution concentration measurement near 50 ng/μl is ±4%.

The molarity of each solution was calculated based on the base distribution of the SIRV sequences according to:

$$MW\ [g/mol] = A*329.2 + U*306.2 + C*305.2 + G*345.2 + 159$$

8 PreMixes were designed that contain 6-11 SIRV transcripts in equimolar ratios. Their length distribution allowes for a unique identification in Bioanalyzer traces as shown in FIG. 14A to monitor the occurrence and the integrity of the SIRVs in the PreMixes and subsequent Mixes (FIGS. 14B, and C). Although the Bioanalyzer traces do not allow for absolute quantitation they were used to follow the relative compound distribution and consistency of the mixing procedure.

The accurate volumetric preparation of the 8 PreMixes was controlled by Nanodrop concentration measurements with a deviation of 0.002%±3.4% (maximal 7.6%) from the calculated target concentrations. The mixing of the volumes was further monitored by weighing on an Analytical Balance, which showed a deviation of 1.8%±0.65% (maximal 2.5%).

The 8 PreMixes were combined pairwise to give 4 Sub-Mixes. The mixing process was quality monitored by electrophoresis as shown in FIG. 14B. The volumetric preparation of the 4 SubMixes was controlled by Nanodrop concentration measurements (deviation of 0.8%±2.5%, maximal 4.5%).

The 4 SubMixes were combined to Final Mixes with defined volumetric ratios, the monitoring of the mixing process by electrophoresis is shown in FIG. 14C. The ratios at which the 4 SubMixes were combined to the Final Mix E0 were 1:1:1:1, for the Final Mix E1 ¼:½:2:1, and for the Final Mix E2 4:¼:1/32:1. Nanodrop concentration measurements showed a deviation of 5.1%±3.3.% (maximal 8.6%) from the calculated target concentrations.

Figure 14:
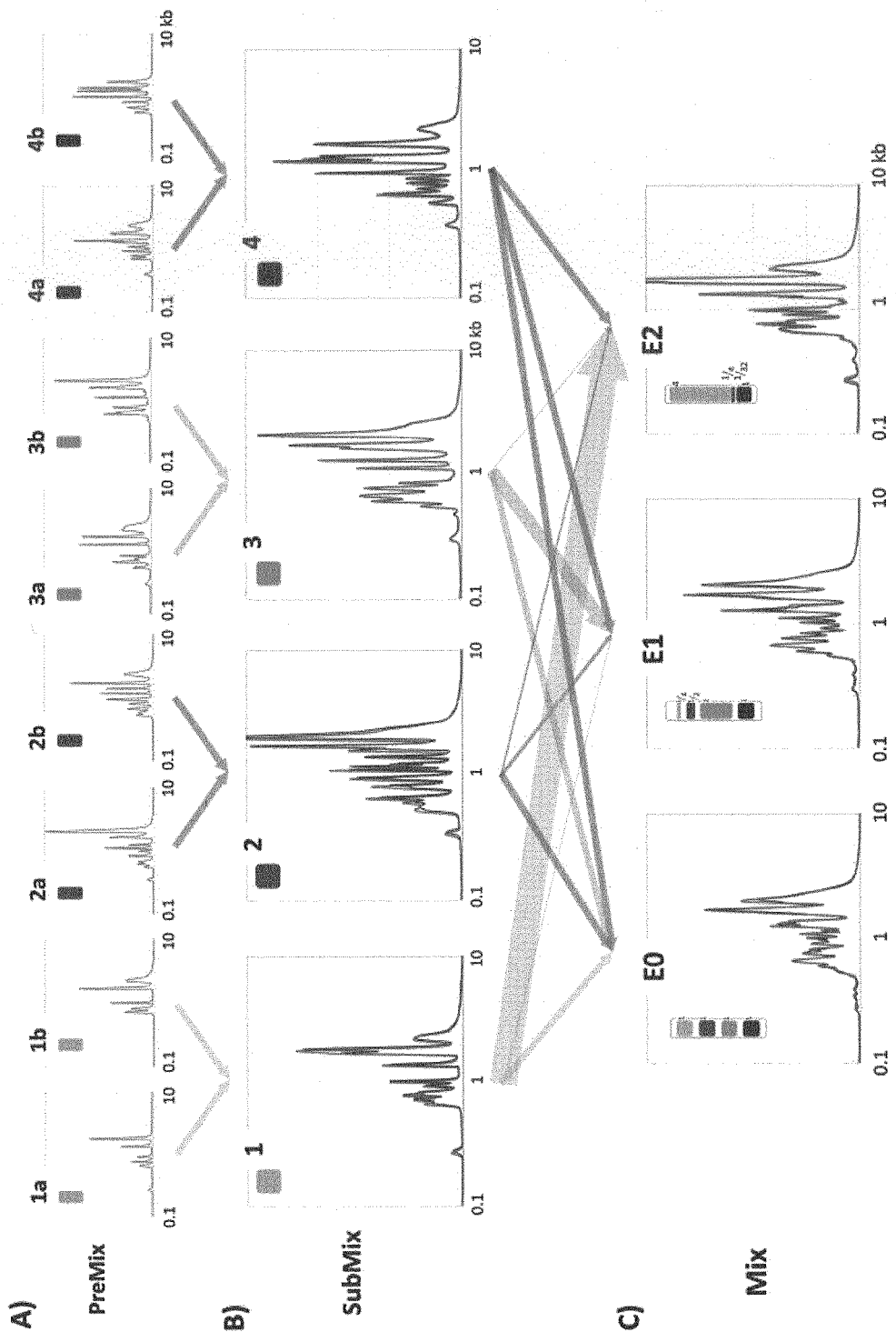
FIG. 14: SIRV mixing scheme to obtain Mixes E0, E1, and E2. A), the 8 PreMixes contain between 6 and 11 SIRVs which are different in length so that the SIRVs can be unambiguously identified in the Bioanalyzer traces. Two PreMixes each were combined in equal ratios to yield four SubMixes in total. These, in turn, were combined in defined ratios to obtain the final Mixes E0, E1 and E2. Measured traces are shown in red, traces computed from the PreMix traces to validate SubMixes and final Mixes are shown in blue.

Within very narrow margins all Bioanalyzer traces of Mixes resemble the sum of their respective Pre- and SubMix constituents (FIG. 14). The relative peak shapes and positions are a reliable quantitative monitoring tool for the SIRV Mixes.

By these means reliable SIRV concentrations and concentration ratios can be assured in different mixtures.

Figure 15:
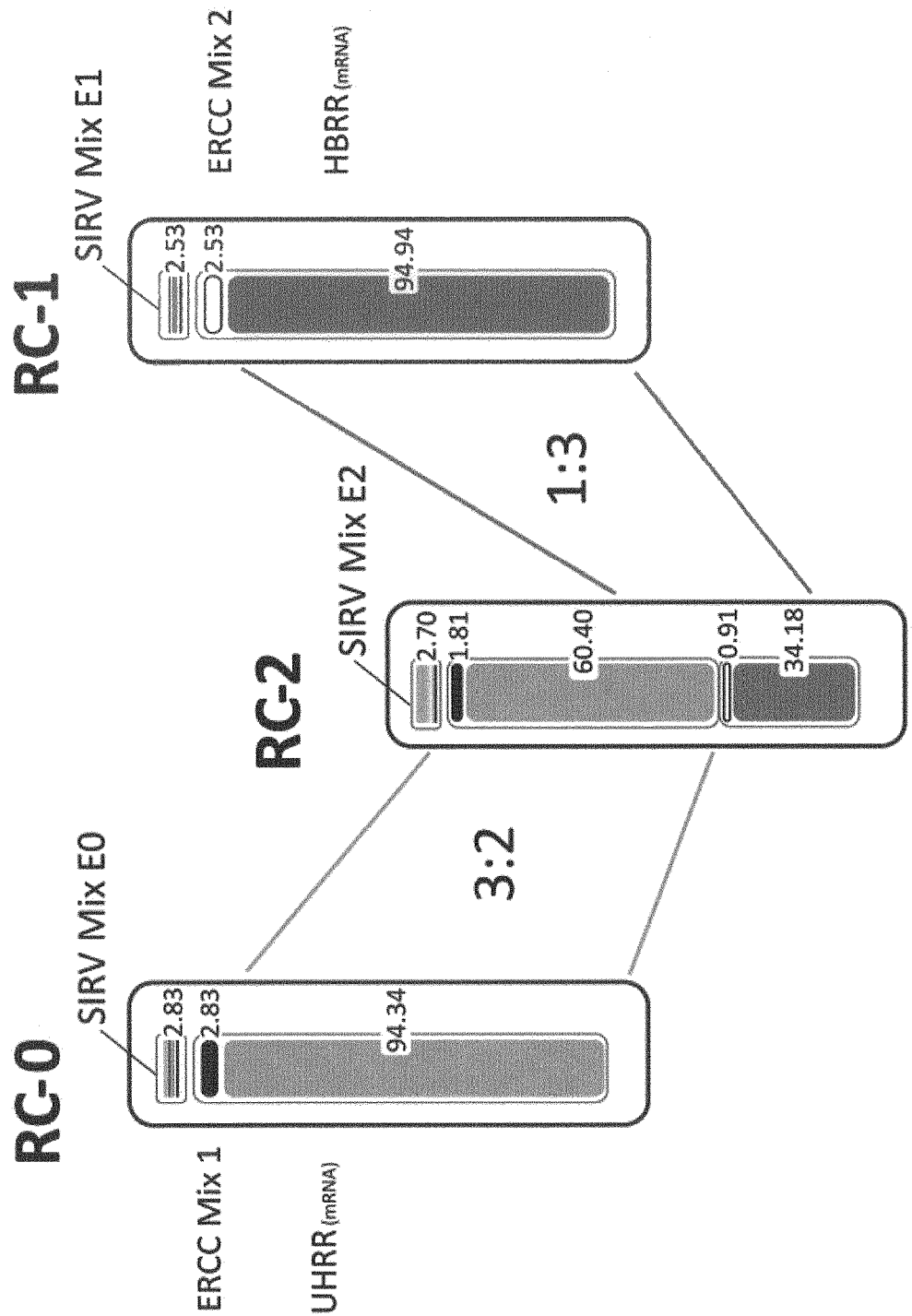
FIG. 15: RNA with Controls. The SIRV Mixes are also available as test-ready reference RNA samples RC-0, RC-1, and RC-2. 1st sample, Universal Human Reference RNA (UHRR, from 10 pooled cancer cell lines, Agilent Technologies, Inc.) was spiked with ERCC ExFold Mix 1; 2nd sample, Human Brain Reference RNA (HBRR, from multiple brain regions of 23 donors, Life Technologies, Inc.,) was spiked ERCC ExFold Mix 2, and for the 3rd sample both were combined in a 2:1 ratio. The 3 samples were then spiked with SIRV Mixes E0, E1, and E2 to obtain the mass ratios as shown in the figure being estimated as relative measure compared to a 2% mRNA content in the total RNA.

The SIRV Mixes E0, E1 and E2 were used to spike Universal Human Reference RNA (UHRR) and Human Brain Reference RNA (HBRR) which contained in addition ERCC control mixes 1 and 2 to create the Reference RNA with controls RC-0, RC-1 and RC-2. The relative amounts of the respective RNA fractions are shown in FIG. 15 and were calculated on the basis of a constant mRNA content of 2% of the total RNA in the UHRR and the HBRR. The final relative concentrations of the spike ins, SIRV and ERCC Mixes, depend on true mRNA content of the reference RNA as well as the depletion and/or enrichment method while reducing the amount of ribosomal and other highly abundant RNA. These samples were designed for testing different RNA-Seq workflows.

Example 7: NGS Sequencing, Data Evaluation of RNA Samples RC-1 and RC-2 with SIRV Mixes and the Setermination of the Accuracy of the RNA Sequencing Pipeline by Using Different Annotations The sequences SEQ ID NOs: 1-74 of the SIRV molecules without poly(A)-tail, and SEQ ID NOs: 156-334 of all exons are the pure SIRV sequences which can be transposed into any common annotation file format. One such example is the combination of a FAS-TA-file which lists the pure nucleotide sequences of all exons, introns and sequences which flank the first and last exons and are called untranslated regions, and corresponding GTF-file which holds the information about the start and end coordinates of the respective exons. The sequences SEQ ID NOs: 156-334 have been transposed to the strand orientations which correspond to the orientation of the human model genes, and all intron sequences have been filled with GC-weighted random sequences of the respective length with all intron donor-acceptor sites correspond in their relative occurrence to the canonical and non-canonical donor acceptor pairs as shown in table 2. SEQ ID NOs: 339-345 (representing a FASTA file with 7 sequences) contain said complete exon and intron sequence together with a 1 kb long upstream and 1 kb long downstream sequence. The GTF files contain information about the variant structures and the following variations are provided as examples, GTF file "SIRV C" (listed in Appendix B) contains the correct annotation of all SIRVs that are in the Mixes E1, and E2. GTF file "SIRV I" (listed in Appendix A) is one of several possibilities of an insufficient annotation. Here, some SIRVs which are actually present in the mixes are not annotated. GTF file "SIRV O" (listed in Appendix C) is one of an endless number of possible over-annotations. Additional SIRVs are annotated, which are not present in the Mixes. In the text these variations of the annotation are referred to as SIRV_C, SIRV_I, and SIRV_O.

The possibilities of data evaluation using the SIRVs are manifold. The following proposal outlines the basic procedures which have to be performed for evaluating the performance of RNA-Seq pipelines. After demultiplexing, barcode and quality trimming, the reads must be mapped to the respective genome, SIRVome (entirety of all SIRV sequences), and where applicable ERCC sequences. All reads which map to the SIRVome can be filtered and treated separately.

The assignments of reads to gene classes provide first overviews about the variability of the spike-in procedure. The SIRV content must be in relationship to its expected mass or molar proportion. For library preparations which aim to cover the length of RNA molecules and lead to measure such as FPKM the proportion of SIRV reads must obey the mass ratio while for library preparations which either tag independently count RNA molecules the SIRV reads must obey the molar ratio. The correction of sample-specific biases is important for differential expression (DE) analyses. Varying RNA sample background, mRNA content and integrity, and variations of depletion and/or mRNA enrichment procedures lead to different SIRV Mix contents in the sequenced libraries. The mRNA content of total RNA samples can vary by a factor of up to 2.5, or beyond. The correction for such biases is important for the correct testing of differential expression, and subsequently relativizing and correcting the DE measurements in RNA samples themselves. The offset factor is a measure of the RNA class distribution and can be used for SIRV control-based normalization. The careful quantitative spike-in procedure of the SIRV mixes is an essential pre-requirement and demands precise volumetric sample processing downstream to sample quantification. All measures and subsequent normalizations need to be set into context with obvious experimental variables like the achievable pipetting accuracy when operating in tiny volumes scales.

In one example triplicates of NGS libraries were produced with 500 ng input RNA of RC-1 and RC-2 using the TruSeq Stranded mRNA Library Prep Kit (Illumina, Inc.) before the six barcoded libraries were sequenced in a paired end sequencing run of nominal 125 bp length on an HiSeq 2500 to obtain 16.27±0.16 Mio trimmed retained paired end reads for the RC-1 triplicates, and 16.97±1.45 Mio for the RC-2 triplicates respectively. The reads were mapped with TopHat2 to the human reference genome, the ERCC sequences and the SIRV sequences. The relative amounts of reads which belong to the SIRVs have been measured to be 2.32±0.05% in sample RC-1, and 1.87±0.12% in sample RC-2.

In FIG. 15, the ratios of the spiked-in SIRVs are presented for better comparison relative to an assumed 2% average mRNA content in the total RNA. However, the true mRNA content is known to be variable. It has been measured before to be close to 3% in UHRR and 2% in the HBRR (Shippy et al., 2006). The mRNA ratio UHRR/HBRR is expected to be 1.5.

Because the reference RNA background of sample RC-2 contains $\frac{2}{3}^{rd}$ of the RC-0 reference RNA background and $\frac{1}{3}^{rd}$ of RC-1 reference RNA background the two SIRV measures in the RC samples RC-1 and RC-2 allow for calculating the mRNA content in the UHRR reference RNA (in sample RC-0; see above). The SIRVs have been spiked into sample RC-1 with 2.53% relative to 2% mRNA, and were measured with 2.32% which results in the value for HBRR mRNA content to be 2.18%, and the mRNA content in sample RC-2 is 2.89% which leads to a calculated value for the UHRR mRNA in to be 3.44%. It allows to determine the mRNA ratio UHRR/HBRR to be 1.58 which confirms the previous published ratio of 1.5. The SIRVs are represented close to 100% based on the spiked in ratios which demonstrates that the poly(A30)-tail is sufficient for the quantitative representation in the poly(A)-enrichment method which is part of the used mRNA NGS library preparation.

Figure 16:
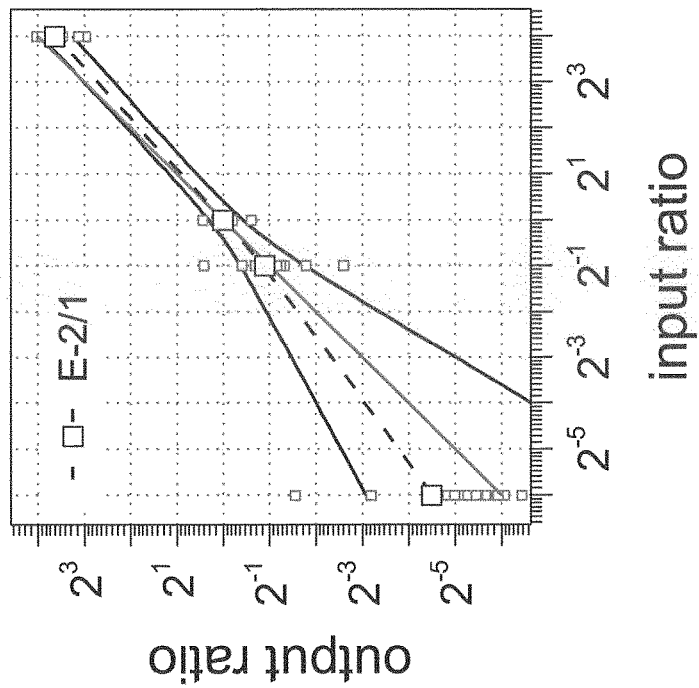
FIG. 16: Input-output correlation of the SIRVs as a result of assigning the SIRV NGS reads to the correct annotation SIRV_C, A), in the sample RC-1 containing E1 and RC-2 containing E2, and B), the differential expression ratio between E2 and E1. The individual data points are shown by small grey symbols and the mean values are highlighted by the large black symbols. The respective lines mark the standard deviation. The grey straight line highlights the diagonal.
Figure 16:
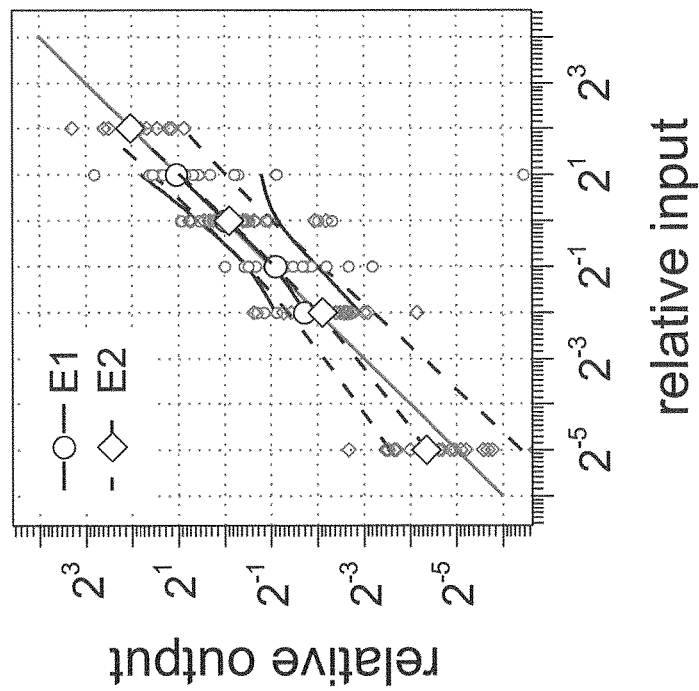

The assignment of SIRV reads with the Cufflinks2 algorithm was performed using the SIRV_C annotation. The abundances were calculated based on the read assignments and could be related to the known input amounts. Input-output correlations were calculated in logarithmic space, but could be done in the linear space too as the set concentration range spans only 1 order of magnitude in RC-1 and 2 orders of magnitude in RC-2. The Pearson product-moment correlation coefficient, Pearson's r, should approach 1, for the correct measurements. The correlation plots are shown in FIG. 16A. The r-value is 0.446 for the SIRVs in sample RC-1 and 0.932 for the SIRVs in sample RC-2, see table 10.

The equimolarity of the 12 to 21 transcripts which originate from the same submixes allow for calculating mean and variances as significant quality measures. For each SIRV Mix the quality of the sequencing pipeline can be demonstrated as a set of 4 relative mean values together with the corresponding variances. The results for the tested pipeline are for RC-1 1.21±56.05%, 0.93±46.56%, 0.97±49.46%, and 1.02±71.62%, and for RC-2 1.56±75.75%, 0.93±54.83%, 0.94±44.46%, and 1.02±54.48% respectively. Although the relative means are close to 1 over the entire concentration range the high variance demonstrates that individual SIRV are determined with large variations.

Table 10. Comparison of spiked-in and measured relative concentrations and concentration ratios in and between the SIRVs in RC-1 and RC-2 after mapping to different annotations SIRV_C, _I and _O. The r-values were calculated in the log-space. The expected and measured total SIRV concentrations are shown for SIRVs actually present in the mixes (row 4), for the insufficient annotated SIRVs (rows 15-16) and for the over-annotated SIRVs (rows 27-28).

| | | | | RC-1 | | RC-2 | | RC-2/1 | |
|---|---|---|---|---|---|---|---|---|---|
| relative conc. and conc. ratio | | | | mean | stdev | mean | stdev | mean | stdev |
| SIRV_C | 69/69 | | | 1 | | 1 | | | |
| | 1/64 | 0.02 | | | | | | 0.04 | 0.07 |
| | 1/32 | 0.03 | | | | 0.05 | 0.04 | | |
| | 1/4 | 0.25 | | 0.30 | 0.17 | 0.23 | 0.13 | | |
| | 1/2 | 0.50 | | 0.46 | 0.22 | | | 0.54 | 0.22 |
| | 1 | 1 | | 0.97 | 0.48 | 0.94 | 0.42 | 1.00 | 0.16 |
| | 2 | 2 | | 2.03 | 1.45 | | | | |
| | 4 | 4 | | | | 4.09 | 2.23 | | |
| | 8 | 8 | | | | | | | |
| | 16 | 16 | | | | | | 12.44 | 2.92 |
| | r-value | | | 0.466 | | 0.932 | | 0.851 | |
| SIRV_I | 44/69 | | | 0.62 | | 0.67 | | | |
| | meas | | | 0.77 | | 0.81 | | | |
| | 1/64 | 0.02 | | | | | | 0.09 | 1.75 |
| | 1/32 | 0.03 | | | | 0.10 | 0.12 | | |
| | 1/4 | 0.25 | | 0.22 | 0.12 | 0.40 | 0.61 | | |
| | 1/2 | 0.50 | | 0.34 | 0.22 | | | 1.09 | 1.42 |
| | 1 | 1 | | 0.98 | 0.42 | 0.70 | 0.51 | 0.81 | 0.75 |
| | 2 | 2 | | 1.45 | 1.17 | | | | |
| | 4 | 4 | | | | 2.93 | 1.43 | | |
| | 8 | 8 | | | | | | | |
| | 16 | 16 | | | | | | 13.09 | 0.40 |
| | r-value | | | 0.407 | | 0.813 | | 0.889 | |
| SIRV_O | 100/69 | | | 1.00 | | 1.00 | | | |
| | meas | | | 1.05 | | 1.03 | | | |
| | 1/64 | 0.02 | | | | | | 0.03 | 0.89 |
| | 1/32 | 0.03 | | | | 0.05 | 0.04 | | |
| | 1/4 | 0.25 | | 0.30 | 0.16 | 0.23 | 0.12 | | |
| | 1/2 | 0.50 | | 0.45 | 0.20 | | | 0.56 | 0.55 |
| | 1 | 1 | | 1.00 | 0.57 | 0.97 | 0.49 | 1.02 | 0.28 |
| | 2 | 2 | | 2.16 | 1.65 | | | | |
| | 4 | 4 | | | | 4.18 | 2.07 | | |
| | 8 | 8 | | | | | | | |
| | 16 | 16 | | | | | | 13.07 | 0.32 |
| | r-value | | | 0.507 | | 0.699 | | 0.871 | |

The most accurate and reproducible assessment can be realized by determining differential expression values or fold changes. As the Mixes were prepared by precise volumetric combination of 4 SubMixes, the differentials are unaffected by other quality measures like the full-length integrity of the SIRVs. The comparison between the expected and measured fold-changes are shown in FIG. 16B, and the mean values are shown alike in table 10, column 9, rows 5 to 13. The relative mean values together with the corresponding variances show values starting at the ratio 1/64 with an offset of 2.82 and a variance of ±169.9%, continuing to 1.07±41.0%, 1.00±16.2 and 0.78±23.5%. The r-value reached 0.851. The relative large variances indicate that the false measurements of individual SIRVs, and foremost inconsistent quantification by the NGS pipeline lead to significant variations, hence uncertainty in the correct quantification. The large variances indicate already that some SIRVs behave non-proportional to the main fraction of the SubMix to which they belong. Four such obvious examples can be seen in the SIRV families 1 and 2, see table 11, and many more in the other SIRV families. While on one hand the differential gene expression of SIRVs 101, 102, 103, 106, 107, 109, 203, 204 and 205 differ by less than 10%, and of SIRV 206 by less than 15% from the set ratio, the ratios of SIRVs 105, 108 and 202 on the other hand diverge by more than 40%, and the ratio of SIRV 201 by more than 250%. The ratios of the majority of species are correct and are evident in all four different SubMixes. Therefore, obvious deviations are caused by errors made in the library generation, sequencing and/or data analysis.

TABLE 11

Comparison of spiked-in and measured (meas) relative concentration ratios of SIRVs from SIRV families 1 and 2.

| | RC-2/1 | | |
|---|---|---|---|
| | set | meas | [%] |
| SIRV101 | 1.00 | 0.98 | 98 |
| SIRV102 | 0.50 | 0.56 | 111 |
| SIRV103 | 1.00 | 0.99 | 99 |
| SIRV105 | 16.00 | 11.10 | 69 |
| SIRV106 | 1.00 | 0.98 | 98 |
| SIRV107 | 16.00 | 14.62 | 91 |
| SIRV108 | 0.50 | 0.29 | 57 |
| SIRV109 | 0.02 | 0.02 | 98 |
| SIRV201 | 0.50 | 1.32 | 265 |
| SIRV202 | 16.00 | 7.86 | 49 |
| SIRV203 | 0.50 | 0.46 | 91 |

TABLE 11-continued

Comparison of spiked-in and measured (meas) relative concentration ratios of SIRVs from SIRV families 1 and 2.

| | RC-2/1 | | |
|---|---|---|---|
| | set | meas | [%] |
| SIRV204 | 1.00 | 0.96 | 96 |
| SIRV205 | 0.02 | 0.02 | 108 |
| SIRV206 | 0.50 | 0.43 | 87 |

The mapping was repeated using the different annotations SIRV_I and SIRV_O. The version SIRV_I (insufficient under-annotation) allows to judge the ability of a pipeline to detect new transcript variants. The experiment shows how reads of non-annotated SIRVs are spuriously distributed to the annotated subset skewing the quantification. The degree of variation in the derived concentrations provides an additional measure for the robustness of the RNA-Seq pipeline. For the present experiment the correlation plots deteriorate. The r-values drop to 0.406 for the SIRVs in sample RC-1 and 0.813 for the SIRVs in sample RC-2. The additional errors seem to propagate evenly and the comparison between the expected and measured fold-changes shows even a slightly higher r-value of 0.889.

The over-annotated version SIRV_O reflects a third situation. Here, more SIRVs are annotated than were actually contained in the samples. The annotation comprises transcript variants which could have been discovered e.g. in other tissues, the same tissue but at different developmental stages, have been falsely annotated, or are relicts of earlier experiments, for which the high number of variants with the typical length of cloned ESTs are typical examples. Now, reads can be assigned to SIRV variants which are actually not part of the real sample. For the present experiment the correlation plots show r-values of 0.506 for RC-1 and 0.699 for RC-2. The comparison between the expected and measured fold-changes display a similar r-value of 0.871.

The degree and robustness of the correct SIRV detection is the measure for the pipeline performance.

The measuring of the level of accuracy in RNA-Seq experiments can be carried out in different ways using SIRV spike-in controls. The variants of a SIRV gene, alike any other natural occurring gene, vary to a different degree in the extent of the unique telling sequences. The uniqueness of sequences is a measure for the complexity of a gene which comprises a combination of "simple" and "more difficult" tasks to be solved when assigning NGS reads to transcript variants. One transcript specific figure within the context of an annotation is the Relative variant Specific Sequence, RSS, which is counted on a nucleotide level and normalized to its length. Shared nucleotides count for each transcript inverse proportional to the number of competing transcript variants. A measure for the sequence complexity, C, is the sum of all inverse RSS values divided by the length of the transcript, L. The relative fold deviation, D, of the measured versus the spiked-in concentrations can now be weighted by the sequence complexity. The challenge of the correct read assignment to the transcript variants is proportional to the underlying complexity of the annotation. The inverse modulus of the log-fold deviation, D, multiplied by the sequence complexity, C, is a measure for weighted accuracy of concentration measures, A, according to:

$$A_{SIRV} = f_1\{(\Sigma(1/RSS))/L\} f_2\{|\log_2 D|\} = f_1\{C\} f_2\{|\log_2 D|\}$$

The two functions, $f_1$ and $f_2$, allow for a weighting of the different components and definition of boundary conditions which would allow for e.g. the perfect concordance of the measured and the spiked-in concentrations where the relative deviation approaches 1, hence the log approaches 0, and the quotient would not defined. As a consequence the correct measurement of all 69 SIRVs within the SIRV_O annotation can reach higher values as within the SIRV_C annotation because it is intrinsically more difficult to obtain the right concentration measures. Fold changes must be assigned with a given threshold as otherwise values close to zero distort meaningful data evaluation.

The Relative variant Specific Sequence, RSS, and complexity, C, can be explained in an example by looking at the overlapping sequences at the start of SIRV1. SIRV107 is an overlapping sense transcript while SIRVs108 and 109 are overlapping antisense transcripts. In the annotation SIRV_I the sequence of SIRV109 is unique because SIRV108 is missing, and all 1/RSS values of each nucleotide are 1, multiplied and divided by the length of SIRV109 the value remains at 1. In the annotation SIRV_C the sequence of SIRV109 is not unique anymore as it shares parts of its sequence with SIRV108. The corresponding 1/RSS values are 2, and the complexity is >1. In the annotation SIRV_O the sequence of SIRV109 shares parts of its sequence only with SIRV108, parts of its sequence only with SIRV110, at which the corresponding 1/RSS values are 2 again, and parts of its sequence with both, with the corresponding 1/RSS values counting 3, while none of its sequence is unique. Here, the C-value of SIRV109 is larger again. The weighted accuracy, A, of SIRV109 is proportional to those C values and inverse proportional to the moduli of the determined $\log_e$-fold deviations from the known SIRV109 input of in the mixes E1 and E2.

The fold-changes allow further to calculate a number of parameters like the true and false positive rates, TP and FP, in calling differential expression. The Area Under the TP vs. FP Curve, AUC, can be taken as measure for the diagnostic performance in differential expression analysis.

Example 8: Diluting, Stabilizing and Preparing Aliquots of the SIRVs and Other Controls for Reliable Application RNAs are prone to degradation by RNases or hydrolysis which is accelerated by divalent cations and temperature. Further, RNA tends to be adsorb by many surfaces. Therefore, RNA controls like RNA ladders for electrophoresis gels or ERCC mixes are provided in concentrations at and above 25 ng/µl in buffers which contain antioxidants and additives like EDTA, DDT, RNasin or other RNase inhibitors. Such RNA solutions are stored at deep temperatures of typically −20° C. When using the RNA controls in the low percentage range to compare to mRNA, then aliquots in the order of tens of pictogram are required, and the high concentrated controls must be diluted manifold before being suitable for spiking-in. When only a few samples need to be processed at one time, then much of the diluted controls have to be disposed. Dilution and the preparation of aliquots holds the risk of introducing unwanted variations.

In the present example the SIRVs are prepared as easy to use and stable aliquots of the total amount required for a given experiment. SIRV mixes like the above described E0, E1, E2 or any other combination of the SIRVs alone or together with additional RNA controls are diluted from a stock solution to 1 pg/µl, 10 pg/µl or 100 pg/µl using a RNase free buffer which contains stabilizing agents like GenTegra-RNA (GenTegra), RNAstable (Biomatrica) or other additives which reduce the degradation of RNA while drying the solution. Then, the solutions with the diluted RNA controls are divided into aliquots to the desired amounts into vials before the solutions are fast dried at either ambient temperatures or lyophilized. When preparing the aliquots time independently from the later application the volumes as well as the number of aliquots can be relative large, which increases the reproducibility of the making of the controls. The dried aliquots of the control RNA can be stored at room temperature.

When the control RNA aliquots are required, the target RNA samples have only to be added to the dried control RNA at any stage of the processing. A short incubation time in the order of a few minutes is required to solve the dried RNA control. By these means the samples is reliable spiked in the RNA control.

In one preferred example the RNA control contains an RNA with an unique identifier like a barcode sequence. The barcode sequence is flanked by an unique artificial sequence which marks the presence of the barcode sequence. The barcode in the control ensures from the moment the RNA sample is being added to the control that this samples is uniquely identified with an internal barcode. The matching of the external sample labeling with the internal barcode ensures that in high-throughput settings no mistaken identities occur.

In any sequencing experiment the presence of the control RNA and barcode ensures the traceability of the sample and comparability of the sample processing.

Example 9: The Combination of the SIRVs with Additional Spike-in Controls Like Micro-RNAs which Account for Sequence-Specific Ligation Biases SIRV can be combined with other RNA controls like the ERCCs, the above mentioned barcode RNAs, or artificial micro-RNAs. Micro-RNAs are short RNAs typically in the order of 21 to 23 nt. Because of their limited size the workflow of micro-RNAs library preparations is different as priming and cDNA synthesis are hindered/affected. The micro-RNA must be direct ligated directly. The terminal sequences and in particular the few start- and end-site are responsible for introducing strong biases which can be as large as 5 orders of magnitude. Therefore, special micro-RNA controls are required which allow for measuring the sequence bias in ligation reactions.

Here, we use artificial micro-RNAs with a random sequence of 4, 5, and up to 8 random nucleotides, N(8), at the start as well as at the end of a sequence which is preferentially 21 to 23 nt long, but can be as short as 16 nt and as long as 36 nt. The artificial micro-RNAs are synthesized. The major hurdle herein is that also mixtures of A, U, G and C are used to compensate any synthesis bias small variations in the miRNA synthesis run can lead to a significant variation in the nucleotide distribution, which in turn should be tightly controlled since it is used to assess biases. Therefore, the artificial micro-RNAs also contain also in the middle part a few random nucleotides, N, at least one, up to the maximum number of N between the N's of the start-site and the N's of the end-site.

While the Ns in the middle provide an independent measure of the randomness in the distribution of the nucleotides, in stretch of N the Ns at the start- and end-site allow to determine the sequence bias of the micro-RNA library preparation.

APPENDIX A

| | | | | | | | | |
|---|---|---|---|---|---|---|---|---|
| | | | | GTFfileSIRVI | | | | |
| SIRV1 | LexogenSIRVData | exon | 1001 | 1484 | . | − | 0 | gene_id "SIRV1"; transcript_id "SIRV101"; exon_assignment "SIRV101_0"; |
| SIRV1 | LexogenSIRVData | exon | 6338 | 6473 | . | − | 0 | gene_id "SIRV1"; transcript_id "SIRV101"; exon_assignment "SIRV101_1"; |
| SIRV1 | LexogenSIRVData | exon | 6561 | 6813 | . | − | 0 | gene_id "SIRV1"; transcript_id "SIRV101"; exon_assignment "SIRV101_2"; |
| SIRV1 | LexogenSIRVData | exon | 7553 | 7814 | . | − | 0 | gene_id "SIRV1"; transcript_id "SIRV101"; exon_assignment "SIRV101_3"; |
| SIRV1 | LexogenSIRVData | exon | 10283 | 10366 | . | − | 0 | gene_id "SIRV1"; transcript_id "SIRV101"; exon_assignment "SIRV101_4"; |
| SIRV1 | LexogenSIRVData | exon | 10445 | 10786 | . | − | 0 | gene_id "SIRV1"; transcript_id "SIRV101"; exon_assignment "SIRV101_5"; |
| SIRV1 | LexogenSIRVData | exon | 1007 | 1484 | . | − | 0 | gene_id "SIRV1"; transcript_id "SIRV102"; exon_assignment "SIRV102_0"; |
| SIRV1 | LexogenSIRVData | exon | 6338 | 6813 | . | − | 0 | gene_id "SIRV1"; transcript_id "SIRV102"; exon_assignment "SIRV102_1"; |
| SIRV1 | LexogenSIRVData | exon | 7553 | 7814 | . | − | 0 | gene_id "SIRV1"; transcript_id "SIRV102"; exon_assignment "SIRV102_2"; |
| SIRV1 | LexogenSIRVData | exon | 10283 | 10366 | . | − | 0 | gene_id "SIRV1"; transcript_id "SIRV102"; exon_assignment "SIRV102_3"; |
| SIRV1 | LexogenSIRVData | exon | 6450 | 6473 | . | − | 0 | gene_id "SIRV1"; transcript_id "SIRV105"; exon_assignment "SIRV105_0"; |
| SIRV1 | LexogenSIRVData | exon | 6561 | 6813 | . | − | 0 | gene_id "SIRV1"; transcript_id "SIRV105"; exon_assignment "SIRV105_1"; |
| SIRV1 | LexogenSIRVData | exon | 7553 | 7814 | . | − | 0 | gene_id "SIRV1"; transcript_id "SIRV105"; exon_assignment "SIRV105_2"; |
| SIRV1 | LexogenSIRVData | exon | 10283 | 10366 | . | − | 0 | gene_id "SIRV1"; transcript_id "SIRV105"; exon_assignment "SIRV105_3"; |
| SIRV1 | LexogenSIRVData | exon | 10594 | 10640 | . | − | 0 | gene_id "SIRV1"; transcript_id "SIRV105"; exon_assignment "SIRV105_4"; |
| SIRV1 | LexogenSIRVData | exon | 10648 | 10791 | . | − | 0 | gene_id "SIRV1"; transcript_id "SIRV107"; exon_assignment "SIRV107_0"; |
| SIRV1 | LexogenSIRVData | exon | 10883 | 11242 | . | − | 0 | gene_id "SIRV1"; transcript_id "SIRV107"; exon_assignment "SIRV107_1"; |
| SIRV1 | LexogenSIRVData | exon | 11404 | 11643 | . | − | 0 | gene_id "SIRV1"; transcript_id "SIRV107"; exon_assignment "SIRV107_2"; |
| SIRV1 | LexogenSIRVData | exon | 10712 | 10791 | . | + | 0 | gene_id "SIRV1"; transcript_id "SIRV109"; exon_assignment "SIRV109_0"; |
| SIRV1 | LexogenSIRVData | exon | 10883 | 11057 | . | + | 0 | gene_id "SIRV1"; transcript_id "SIRV109"; exon_assignment "SIRV109_1"; |
| SIRV1 | LexogenSIRVData | exon | 11435 | 11643 | . | + | 0 | gene_id "SIRV1"; transcript_id "SIRV109"; exon_assignment "SIRV109_2"; |
| SIRV2 | LexogenSIRVData | exon | 1001 | 1661 | . | − | 0 | gene_id "SIRV2"; transcript_id "SIRV201"; exon_assignment "SIRV201_0"; |
| SIRV2 | LexogenSIRVData | exon | 1742 | 1853 | . | − | 0 | gene_id "SIRV2"; transcript_id "SIRV201"; exon_assignment "SIRV201_1"; |
| SIRV2 | LexogenSIRVData | exon | 1974 | 2064 | . | − | 0 | gene_id "SIRV2"; transcript_id "SIRV201"; exon_assignment "SIRV201_2"; |
| SIRV2 | LexogenSIRVData | exon | 2675 | 2802 | . | − | 0 | gene_id "SIRV2"; transcript_id "SIRV201"; exon_assignment "SIRV201_3"; |
| SIRV2 | LexogenSIRVData | exon | 2882 | 3010 | . | − | 0 | gene_id "SIRV2"; transcript_id "SIRV201"; exon_assignment "SIRV201_4"; |
| SIRV2 | LexogenSIRVData | exon | 3106 | 3374 | . | − | 0 | gene_id "SIRV2"; transcript_id "SIRV201"; exon_assignment "SIRV201_5"; |
| SIRV2 | LexogenSIRVData | exon | 3666 | 3825 | . | − | 0 | gene_id "SIRV2"; transcript_id "SIRV201"; exon_assignment "SIRV201_6"; |
| SIRV2 | LexogenSIRVData | exon | 3967 | 4094 | . | − | 0 | gene_id "SIRV2"; transcript_id "SIRV201"; exon_assignment "SIRV201_7"; |
| SIRV2 | LexogenSIRVData | exon | 4339 | 4479 | . | − | 0 | gene_id "SIRV2"; transcript_id "SIRV201"; exon_assignment "SIRV201_8"; |
| SIRV2 | LexogenSIRVData | exon | 4688 | 4800 | . | − | 0 | gene_id "SIRV2"; transcript_id "SIRV201"; exon_assignment "SIRV201_9"; |
| SIRV2 | LexogenSIRVData | exon | 5789 | 5907 | . | − | 0 | gene_id "SIRV2"; transcript_id "SIRV201"; exon_assignment "SIRV201_10"; |

APPENDIX A-continued

| | | | | | | | | |
|---|---|---|---|---|---|---|---|---|
| | | | | GTFfileSIRVI | | | | |
| SIRV2 | LexogenSIRVData | exon | 3666 | 3825 | . | − | 0 | gene_id "SIRV2"; transcript_id "SIRV203"; exon_assignment "SIRV203_0"; |
| SIRV2 | LexogenSIRVData | exon | 3967 | 4094 | . | − | 0 | gene_id "SIRV2"; transcript_id "SIRV203"; exon_assignment "SIRV203_1"; |
| SIRV2 | LexogenSIRVData | exon | 4339 | 4479 | . | − | 0 | gene_id "SIRV2"; transcript_id "SIRV203"; exon_assignment "SIRV203_2"; |
| SIRV2 | LexogenSIRVData | exon | 4688 | 4800 | . | − | 0 | gene_id "SIRV2"; transcript_id "SIRV203"; exon_assignment "SIRV203_3"; |
| SIRV2 | LexogenSIRVData | exon | 5752 | 5895 | . | − | 0 | gene_id "SIRV2"; transcript_id "SIRV203"; exon_assignment "SIRV203_4"; |
| SIRV3 | LexogenSIRVData | exon | 4034 | 4457 | . | − | 0 | gene_id "SIRV2"; transcript_id "SIRV206"; exon_assignment "SIRV206_0"; |
| SIRV3 | LexogenSIRVData | exon | 1945 | 2005 | . | + | 0 | gene_id "SIRV3"; transcript_id "SIRV301"; exon_assignment "SIRV301_0"; |
| SIRV3 | LexogenSIRVData | exon | 4569 | 4779 | . | + | 0 | gene_id "SIRV3"; transcript_id "SIRV301"; exon_assignment "SIRV301_1"; |
| SIRV3 | LexogenSIRVData | exon | 6058 | 7988 | . | + | 0 | gene_id "SIRV3"; transcript_id "SIRV301"; exon_assignment "SIRV301_2"; |
| SIRV3 | LexogenSIRVData | exon | 8128 | 8207 | . | + | 0 | gene_id "SIRV3"; transcript_id "SIRV301"; exon_assignment "SIRV301_3"; |
| SIRV3 | LexogenSIRVData | exon | 8756 | 8939 | . | + | 0 | gene_id "SIRV3"; transcript_id "SIRV301"; exon_assignment "SIRV301_4"; |
| SIRV3 | LexogenSIRVData | exon | 1964 | 2005 | . | + | 0 | gene_id "SIRV3"; transcript_id "SIRV303"; exon_assignment "SIRV303_0"; |
| SIRV3 | LexogenSIRVData | exon | 4569 | 4779 | . | + | 0 | gene_id "SIRV3"; transcript_id "SIRV303"; exon_assignment "SIRV303_1"; |
| SIRV3 | LexogenSIRVData | exon | 6058 | 7822 | . | + | 0 | gene_id "SIRV3"; transcript_id "SIRV303"; exon_assignment "SIRV303_2"; |
| SIRV3 | LexogenSIRVData | exon | 1964 | 2005 | . | + | 0 | gene_id "SIRV3"; transcript_id "SIRV304"; exon_assignment "SIRV304_0"; |
| SIRV3 | LexogenSIRVData | exon | 4004 | 4080 | . | + | 0 | gene_id "SIRV3"; transcript_id "SIRV304"; exon_assignment "SIRV304_1"; |
| SIRV3 | LexogenSIRVData | exon | 4569 | 4779 | . | + | 0 | gene_id "SIRV3"; transcript_id "SIRV304"; exon_assignment "SIRV304_2"; |
| SIRV3 | LexogenSIRVData | exon | 6058 | 6333 | . | + | 0 | gene_id "SIRV3"; transcript_id "SIRV304"; exon_assignment "SIRV304_3"; |
| SIRV3 | LexogenSIRVData | exon | 7271 | 7366 | . | + | 0 | gene_id "SIRV3"; transcript_id "SIRV304"; exon_assignment "SIRV304_4"; |
| SIRV3 | LexogenSIRVData | exon | 7873 | 7988 | . | + | 0 | gene_id "SIRV3"; transcript_id "SIRV304"; exon_assignment "SIRV304_5"; |
| SIRV3 | LexogenSIRVData | exon | 8125 | 8207 | . | + | 0 | gene_id "SIRV3"; transcript_id "SIRV304"; exon_assignment "SIRV304_6"; |
| SIRV3 | LexogenSIRVData | exon | 8756 | 8937 | . | + | 0 | gene_id "SIRV3"; transcript_id "SIRV304"; exon_assignment "SIRV304_7"; |
| SIRV3 | LexogenSIRVData | exon | 4004 | 4080 | . | + | 0 | gene_id "SIRV3"; transcript_id "SIRV305"; exon_assignment "SIRV305_0"; |
| SIRV3 | LexogenSIRVData | exon | 4569 | 4779 | . | + | 0 | gene_id "SIRV3"; transcript_id "SIRV305"; exon_assignment "SIRV305_1"; |
| SIRV3 | LexogenSIRVData | exon | 6571 | 6718 | . | + | 0 | gene_id "SIRV3"; transcript_id "SIRV305"; exon_assignment "SIRV305_2"; |
| SIRV3 | LexogenSIRVData | exon | 1964 | 2005 | . | + | 0 | gene_id "SIRV3"; transcript_id "SIRV307"; exon_assignment "SIRV307_0"; |
| SIRV3 | LexogenSIRVData | exon | 4004 | 4080 | . | + | 0 | gene_id "SIRV3"; transcript_id "SIRV307"; exon_assignment "SIRV307_1"; |
| SIRV3 | LexogenSIRVData | exon | 4575 | 4774 | . | + | 0 | gene_id "SIRV3"; transcript_id "SIRV307"; exon_assignment "SIRV307_2"; |
| SIRV3 | LexogenSIRVData | exon | 6058 | 6333 | . | + | 0 | gene_id "SIRV3"; transcript_id "SIRV307"; exon_assignment "SIRV307_3"; |
| SIRV3 | LexogenSIRVData | exon | 8756 | 8939 | . | + | 0 | gene_id "SIRV3"; transcript_id "SIRV307"; exon_assignment "SIRV307_4"; |
| SIRV3 | LexogenSIRVData | exon | 1001 | 1167 | . | − | 0 | gene_id "SIRV3"; transcript_id "SIRV308"; exon_assignment "SIRV308_0"; |
| SIRV3 | LexogenSIRVData | exon | 1533 | 1764 | . | − | 0 | gene_id "SIRV3"; transcript_id "SIRV308"; exon_assignment "SIRV308_1"; |
| SIRV3 | LexogenSIRVData | exon | 1903 | 1982 | . | − | 0 | gene_id "SIRV3"; transcript_id "SIRV308"; exon_assignment "SIRV308_2"; |
| SIRV3 | LexogenSIRVData | exon | 8798 | 8975 | . | − | 0 | gene_id "SIRV3"; transcript_id "SIRV309"; exon_assignment "SIRV309_0"; |
| SIRV3 | LexogenSIRVData | exon | 9190 | 9298 | . | − | 0 | gene_id "SIRV3"; transcript_id "SIRV309"; exon_assignment "SIRV309_1"; |
| SIRV3 | LexogenSIRVData | exon | 9435 | 9943 | . | − | 0 | gene_id "SIRV3"; transcript_id "SIRV309"; exon_assignment "SIRV309_2"; |
| SIRV3 | LexogenSIRVData | exon | 4602 | 4762 | . | − | 0 | gene_id "SIRV3"; transcript_id "SIRV311"; exon_assignment "SIRV311_0"; |
| SIRV4 | LexogenSIRVData | exon | 8323 | 8372 | . | − | 0 | gene_id "SIRV4"; transcript_id "SIRV403"; exon_assignment "SIRV403_0"; |
| SIRV4 | LexogenSIRVData | exon | 8630 | 8990 | . | − | 0 | gene_id "SIRV4"; transcript_id "SIRV403"; exon_assignment "SIRV403_1"; |
| SIRV4 | LexogenSIRVData | exon | 13673 | 13828 | . | − | 0 | gene_id "SIRV4"; transcript_id "SIRV403"; exon_assignment "SIRV403_2"; |
| SIRV4 | LexogenSIRVData | exon | 15020 | 15122 | . | − | 0 | gene_id "SIRV4"; transcript_id "SIRV403"; exon_assignment "SIRV403_3"; |
| SIRV4 | LexogenSIRVData | exon | 8630 | 8990 | . | − | 0 | gene_id "SIRV4"; transcript_id "SIRV405"; exon_assignment "SIRV405_0"; |
| SIRV4 | LexogenSIRVData | exon | 13673 | 13937 | . | − | 0 | gene_id "SIRV4"; transcript_id "SIRV405"; exon_assignment "SIRV405_1"; |
| SIRV4 | LexogenSIRVData | exon | 3638 | 4103 | . | − | 0 | gene_id "SIRV4"; transcript_id "SIRV406"; exon_assignment "SIRV406_0"; |
| SIRV4 | LexogenSIRVData | exon | 5008 | 5158 | . | − | 0 | gene_id "SIRV4"; transcript_id "SIRV406"; exon_assignment "SIRV406_1"; |
| SIRV4 | LexogenSIRVData | exon | 8324 | 8372 | . | − | 0 | gene_id "SIRV4"; transcript_id "SIRV408"; exon_assignment "SIRV408_0"; |
| SIRV4 | LexogenSIRVData | exon | 8630 | 8747 | . | − | 0 | gene_id "SIRV4"; transcript_id "SIRV408"; exon_assignment "SIRV408_1"; |
| SIRV4 | LexogenSIRVData | exon | 8847 | 8990 | . | − | 0 | gene_id "SIRV4"; transcript_id "SIRV408"; exon_assignment "SIRV408_2"; |
| SIRV4 | LexogenSIRVData | exon | 13673 | 13828 | . | − | 0 | gene_id "SIRV4"; transcript_id "SIRV408"; exon_assignment "SIRV408_3"; |
| SIRV4 | LexogenSIRVData | exon | 15020 | 15122 | . | − | 0 | gene_id "SIRV4"; transcript_id "SIRV408"; exon_assignment "SIRV408_4"; |
| SIRV4 | LexogenSIRVData | exon | 1001 | 1346 | . | + | 0 | gene_id "SIRV4"; transcript_id "SIRV409"; exon_assignment "SIRV409_0"; |
| SIRV4 | LexogenSIRVData | exon | 1679 | 1885 | . | + | 0 | gene_id "SIRV4"; transcript_id "SIRV409"; exon_assignment "SIRV409_1"; |
| SIRV4 | LexogenSIRVData | exon | 2390 | 3403 | . | + | 0 | gene_id "SIRV4"; transcript_id "SIRV409"; exon_assignment "SIRV409_2"; |
| SIRV5 | LexogenSIRVData | exon | 1057 | 1149 | . | + | 0 | gene_id "SIRV5"; transcript_id "SIRV501"; exon_assignment "SIRV501_0"; |
| SIRV5 | LexogenSIRVData | exon | 1988 | 2033 | . | + | 0 | gene_id "SIRV5"; transcript_id "SIRV501"; exon_assignment "SIRV501_1"; |
| SIRV5 | LexogenSIRVData | exon | 2120 | 2315 | . | + | 0 | gene_id "SIRV5"; transcript_id "SIRV501"; exon_assignment "SIRV501_2"; |
| SIRV5 | LexogenSIRVData | exon | 3299 | 3404 | . | + | 0 | gene_id "SIRV5"; transcript_id "SIRV501"; exon_assignment "SIRV501_3"; |
| SIRV5 | LexogenSIRVData | exon | 3484 | 3643 | . | + | 0 | gene_id "SIRV5"; transcript_id "SIRV501"; exon_assignment "SIRV501_4"; |
| SIRV5 | LexogenSIRVData | exon | 5381 | 5450 | . | + | 0 | gene_id "SIRV5"; transcript_id "SIRV501"; exon_assignment "SIRV501_5"; |
| SIRV5 | LexogenSIRVData | exon | 5544 | 5626 | . | + | 0 | gene_id "SIRV5"; transcript_id "SIRV501"; exon_assignment "SIRV501_6"; |
| SIRV5 | LexogenSIRVData | exon | 6112 | 6169 | . | + | 0 | gene_id "SIRV5"; transcript_id "SIRV501"; exon_assignment "SIRV501_7"; |
| SIRV5 | LexogenSIRVData | exon | 6328 | 6452 | . | + | 0 | gene_id "SIRV5"; transcript_id "SIRV501"; exon_assignment "SIRV501_8"; |
| SIRV5 | LexogenSIRVData | exon | 6659 | 6722 | . | + | 0 | gene_id "SIRV5"; transcript_id "SIRV501"; exon_assignment "SIRV501_9"; |
| SIRV5 | LexogenSIRVData | exon | 6827 | 6957 | . | + | 0 | gene_id "SIRV5"; transcript_id "SIRV501"; exon_assignment "SIRV501_10"; |
| SIRV5 | LexogenSIRVData | exon | 7145 | 7307 | . | + | 0 | gene_id "SIRV5"; transcript_id "SIRV501"; exon_assignment "SIRV501_11"; |
| SIRV5 | LexogenSIRVData | exon | 7682 | 7762 | . | + | 0 | gene_id "SIRV5"; transcript_id "SIRV501"; exon_assignment "SIRV501_12"; |
| SIRV5 | LexogenSIRVData | exon | 7871 | 8016 | . | + | 0 | gene_id "SIRV5"; transcript_id "SIRV501"; exon_assignment "SIRV501_13"; |
| SIRV5 | LexogenSIRVData | exon | 8278 | 8381 | . | + | 0 | gene_id "SIRV5"; transcript_id "SIRV501"; exon_assignment "SIRV501_14"; |
| SIRV5 | LexogenSIRVData | exon | 8455 | 8585 | . | + | 0 | gene_id "SIRV5"; transcript_id "SIRV501"; exon_assignment "SIRV501_15"; |
| SIRV5 | LexogenSIRVData | exon | 10859 | 10991 | . | + | 0 | gene_id "SIRV5"; transcript_id "SIRV501"; exon_assignment "SIRV501_16"; |
| SIRV5 | LexogenSIRVData | exon | 1020 | 1149 | . | + | 0 | gene_id "SIRV5"; transcript_id "SIRV502"; exon_assignment "SIRV502_0"; |
| SIRV5 | LexogenSIRVData | exon | 1988 | 2033 | . | + | 0 | gene_id "SIRV5"; transcript_id "SIRV502"; exon_assignment "SIRV502_1"; |
| SIRV5 | LexogenSIRVData | exon | 2120 | 2156 | . | + | 0 | gene_id "SIRV5"; transcript_id "SIRV502"; exon_assignment "SIRV502_2"; |
| SIRV5 | LexogenSIRVData | exon | 2271 | 2488 | . | + | 0 | gene_id "SIRV5"; transcript_id "SIRV502"; exon_assignment "SIRV502_3"; |
| SIRV5 | LexogenSIRVData | exon | 3299 | 3404 | . | + | 0 | gene_id "SIRV5"; transcript_id "SIRV502"; exon_assignment "SIRV502_4"; |
| SIRV5 | LexogenSIRVData | exon | 3484 | 3643 | . | + | 0 | gene_id "SIRV5"; transcript_id "SIRV502"; exon_assignment "SIRV502_5"; |
| SIRV5 | LexogenSIRVData | exon | 5381 | 5450 | . | + | 0 | gene_id "SIRV5"; transcript_id "SIRV502"; exon_assignment "SIRV502_6"; |
| SIRV5 | LexogenSIRVData | exon | 5544 | 5626 | . | + | 0 | gene_id "SIRV5"; transcript_id "SIRV502"; exon_assignment "SIRV502_7"; |

APPENDIX A-continued

GTFfileSIRVI

| | | | | | | | | |
|---|---|---|---|---|---|---|---|---|
| SIRV5 | LexogenSIRVData | exon | 6112 | 6169 | . | + | 0 | gene_id "SIRV5"; transcript_id "SIRV502"; exon_assignment "SIRV502_8"; |
| SIRV5 | LexogenSIRVData | exon | 6328 | 6452 | . | + | 0 | gene_id "SIRV5"; transcript_id "SIRV502"; exon_assignment "SIRV502_9"; |
| SIRV5 | LexogenSIRVData | exon | 6659 | 6722 | . | + | 0 | gene_id "SIRV5"; transcript_id "SIRV502"; exon_assignment "SIRV502_10"; |
| SIRV5 | LexogenSIRVData | exon | 6827 | 6957 | . | + | 0 | gene_id "SIRV5"; transcript_id "SIRV502"; exon_assignment "SIRV502_11"; |
| SIRV5 | LexogenSIRVData | exon | 7145 | 7307 | . | + | 0 | gene_id "SIRV5"; transcript_id "SIRV502"; exon_assignment "SIRV502_12"; |
| SIRV5 | LexogenSIRVData | exon | 7682 | 7762 | . | + | 0 | gene_id "SIRV5"; transcript_id "SIRV502"; exon_assignment "SIRV502_13"; |
| SIRV5 | LexogenSIRVData | exon | 7871 | 8016 | . | + | 0 | gene_id "SIRV5"; transcript_id "SIRV502"; exon_assignment "SIRV502_14"; |
| SIRV5 | LexogenSIRVData | exon | 8278 | 8381 | . | + | 0 | gene_id "SIRV5"; transcript_id "SIRV502"; exon_assignment "SIRV502_15"; |
| SIRV5 | LexogenSIRVData | exon | 8455 | 8585 | . | + | 0 | gene_id "SIRV5"; transcript_id "SIRV502"; exon_assignment "SIRV502_16"; |
| SIRV5 | LexogenSIRVData | exon | 10859 | 10989 | . | + | 0 | gene_id "SIRV5"; transcript_id "SIRV502"; exon_assignment "SIRV502_17"; |
| SIRV5 | LexogenSIRVData | exon | 11134 | 13606 | . | + | 0 | gene_id "SIRV5"; transcript_id "SIRV504"; exon_assignment "SIRV504_0"; |
| SIRV5 | LexogenSIRVData | exon | 1001 | 1149 | . | + | 0 | gene_id "SIRV5"; transcript_id "SIRV505"; exon_assignment "SIRV505_0"; |
| SIRV5 | LexogenSIRVData | exon | 1988 | 2033 | . | + | 0 | gene_id "SIRV5"; transcript_id "SIRV505"; exon_assignment "SIRV505_1"; |
| SIRV5 | LexogenSIRVData | exon | 2120 | 2156 | . | + | 0 | gene_id "SIRV5"; transcript_id "SIRV505"; exon_assignment "SIRV505_2"; |
| SIRV5 | LexogenSIRVData | exon | 2271 | 2315 | . | + | 0 | gene_id "SIRV5"; transcript_id "SIRV505"; exon_assignment "SIRV505_3"; |
| SIRV5 | LexogenSIRVData | exon | 3299 | 3404 | . | + | 0 | gene_id "SIRV5"; transcript_id "SIRV505"; exon_assignment "SIRV505_4"; |
| SIRV5 | LexogenSIRVData | exon | 3484 | 3643 | . | + | 0 | gene_id "SIRV5"; transcript_id "SIRV505"; exon_assignment "SIRV505_4"; |
| SIRV5 | LexogenSIRVData | exon | 5381 | 5450 | . | + | 0 | gene_id "SIRV5"; transcript_id "SIRV505"; exon_assignment "SIRV505_6"; |
| SIRV5 | LexogenSIRVData | exon | 5544 | 5626 | . | + | 0 | gene_id "SIRV5"; transcript_id "SIRV505"; exon_assignment "SIRV505_7"; |
| SIRV5 | LexogenSIRVData | exon | 6112 | 6169 | . | + | 0 | gene_id "SIRV5"; transcript_id "SIRV505"; exon_assignment "SIRV505_8"; |
| SIRV5 | LexogenSIRVData | exon | 6328 | 6452 | . | + | 0 | gene_id "SIRV5"; transcript_id "SIRV505"; exon_assignment "SIRV505_9"; |
| SIRV5 | LexogenSIRVData | exon | 6827 | 6957 | . | + | 0 | gene_id "SIRV5"; transcript_id "SIRV505"; exon_assignment "SIRV505_10"; |
| SIRV5 | LexogenSIRVData | exon | 7145 | 7307 | . | + | 0 | gene_id "SIRV5"; transcript_id "SIRV505"; exon_assignment "SIRV505_11"; |
| SIRV5 | LexogenSIRVData | exon | 7682 | 7762 | . | + | 0 | gene_id "SIRV5"; transcript_id "SIRV505"; exon_assignment "SIRV505_12"; |
| SIRV5 | LexogenSIRVData | exon | 7871 | 8381 | . | + | 0 | gene_id "SIRV5"; transcript_id "SIRV505"; exon_assignment "SIRV505_13"; |
| SIRV5 | LexogenSIRVData | exon | 8455 | 8585 | . | + | 0 | gene_id "SIRV5"; transcript_id "SIRV505"; exon_assignment "SIRV505_14"; |
| SIRV5 | LexogenSIRVData | exon | 10859 | 10991 | . | + | 0 | gene_id "SIRV5"; transcript_id "SIRV505"; exon_assignment "SIRV505_15"; |
| SIRV5 | LexogenSIRVData | exon | 1009 | 1149 | . | + | 0 | gene_id "SIRV5"; transcript_id "SIRV506"; exon_assignment "SIRV506_0"; |
| SIRV5 | LexogenSIRVData | exon | 1988 | 2398 | . | + | 0 | gene_id "SIRV5"; transcript_id "SIRV506"; exon_assignment "SIRV506_1"; |
| SIRV5 | LexogenSIRVData | exon | 1009 | 1149 | . | + | 0 | gene_id "SIRV5"; transcript_id "SIRV508"; exon_assignment "SIRV508_0"; |
| SIRV5 | LexogenSIRVData | exon | 1988 | 2033 | . | + | 0 | gene_id "SIRV5"; transcript_id "SIRV508"; exon_assignment "SIRV508_1"; |
| SIRV5 | LexogenSIRVData | exon | 2120 | 2156 | . | + | 0 | gene_id "SIRV5"; transcript_id "SIRV508"; exon_assignment "SIRV508_2"; |
| SIRV5 | LexogenSIRVData | exon | 2271 | 2315 | . | + | 0 | gene_id "SIRV5"; transcript_id "SIRV508"; exon_assignment "SIRV508_3"; |
| SIRV5 | LexogenSIRVData | exon | 3299 | 3404 | . | + | 0 | gene_id "SIRV5"; transcript_id "SIRV508"; exon_assignment "SIRV508_4"; |
| SIRV5 | LexogenSIRVData | exon | 3484 | 3643 | . | + | 0 | gene_id "SIRV5"; transcript_id "SIRV508"; exon_assignment "SIRV508_5"; |
| SIRV5 | LexogenSIRVData | exon | 5381 | 5450 | . | + | 0 | gene_id "SIRV5"; transcript_id "SIRV508"; exon_assignment "SIRV508_6"; |
| SIRV5 | LexogenSIRVData | exon | 5544 | 5626 | . | + | 0 | gene_id "SIRV5"; transcript_id "SIRV508"; exon_assignment "SIRV508_7"; |
| SIRV5 | LexogenSIRVData | exon | 6112 | 6169 | . | + | 0 | gene_id "SIRV5"; transcript_id "SIRV508"; exon_assignment "SIRV508_8"; |
| SIRV5 | LexogenSIRVData | exon | 6328 | 6452 | . | + | 0 | gene_id "SIRV5"; transcript_id "SIRV508"; exon_assignment "SIRV508_9"; |
| SIRV5 | LexogenSIRVData | exon | 6659 | 6722 | . | + | 0 | gene_id "SIRV5"; transcript_id "SIRV508"; exon_assignment "SIRV508_10"; |
| SIRV5 | LexogenSIRVData | exon | 6827 | 6957 | . | + | 0 | gene_id "SIRV5"; transcript_id "SIRV508"; exon_assignment "SIRV508_11"; |
| SIRV5 | LexogenSIRVData | exon | 7145 | 7307 | . | + | 0 | gene_id "SIRV5"; transcript_id "SIRV508"; exon_assignment "SIRV508_12"; |
| SIRV5 | LexogenSIRVData | exon | 7682 | 7762 | . | + | 0 | gene_id "SIRV5"; transcript_id "SIRV508"; exon_assignment "SIRV508_13"; |
| SIRV5 | LexogenSIRVData | exon | 7871 | 8381 | . | + | 0 | gene_id "SIRV5"; transcript_id "SIRV508"; exon_assignment "SIRV508_14"; |
| SIRV5 | LexogenSIRVData | exon | 8455 | 8585 | . | + | 0 | gene_id "SIRV5"; transcript_id "SIRV508"; exon_assignment "SIRV508_15"; |
| SIRV5 | LexogenSIRVData | exon | 10859 | 10991 | . | + | 0 | gene_id "SIRV5"; transcript_id "SIRV508"; exon_assignment "SIRV508_16"; |
| SIRV5 | LexogenSIRVData | exon | 2178 | 2406 | . | − | 0 | gene_id "SIRV5"; transcript_id "SIRV512"; exon_assignment "SIRV512_0"; |
| SIRV6 | LexogenSIRVData | exon | 1001 | 1186 | . | + | 0 | gene_id "SIRV6"; transcript_id "SIRV601"; exon_assignment "SIRV601_0"; |
| SIRV6 | LexogenSIRVData | exon | 1469 | 1534 | . | + | 0 | gene_id "SIRV6"; transcript_id "SIRV601"; exon_assignment "SIRV601_1"; |
| SIRV6 | LexogenSIRVData | exon | 1641 | 1735 | . | + | 0 | gene_id "SIRV6"; transcript_id "SIRV601"; exon_assignment "SIRV601_2"; |
| SIRV6 | LexogenSIRVData | exon | 2471 | 2620 | . | + | 0 | gene_id "SIRV6"; transcript_id "SIRV601"; exon_assignment "SIRV601_3"; |
| SIRV6 | LexogenSIRVData | exon | 2741 | 2828 | . | + | 0 | gene_id "SIRV6"; transcript_id "SIRV601"; exon_assignment "SIRV601_4"; |
| SIRV6 | LexogenSIRVData | exon | 3107 | 3164 | . | + | 0 | gene_id "SIRV6"; transcript_id "SIRV601"; exon_assignment "SIRV601_5"; |
| SIRV6 | LexogenSIRVData | exon | 10725 | 10818 | . | + | 0 | gene_id "SIRV6"; transcript_id "SIRV601"; exon_assignment "SIRV601_6"; |
| SIRV6 | LexogenSIRVData | exon | 11032 | 11108 | . | + | 0 | gene_id "SIRV6"; transcript_id "SIRV601"; exon_assignment "SIRV601_7"; |
| SIRV6 | LexogenSIRVData | exon | 11206 | 11826 | . | + | 0 | gene_id "SIRV6"; transcript_id "SIRV601"; exon_assignment "SIRV601_8"; |
| SIRV6 | LexogenSIRVData | exon | 9000 | 10968 | . | + | 0 | gene_id "SIRV6"; transcript_id "SIRV603"; exon_assignment "SIRV603_0"; |
| SIRV6 | LexogenSIRVData | exon | 1088 | 1186 | . | + | 0 | gene_id "SIRV6"; transcript_id "SIRV604"; exon_assignment "SIRV604_0"; |
| SIRV6 | LexogenSIRVData | exon | 1469 | 1534 | . | + | 0 | gene_id "SIRV6"; transcript_id "SIRV604"; exon_assignment "SIRV604_1"; |
| SIRV6 | LexogenSIRVData | exon | 1641 | 1735 | . | + | 0 | gene_id "SIRV6"; transcript_id "SIRV604"; exon_assignment "SIRV604_2"; |
| SIRV6 | LexogenSIRVData | exon | 1846 | 2026 | . | + | 0 | gene_id "SIRV6"; transcript_id "SIRV604"; exon_assignment "SIRV604_3"; |
| SIRV6 | LexogenSIRVData | exon | 2471 | 2620 | . | + | 0 | gene_id "SIRV6"; transcript_id "SIRV604"; exon_assignment "SIRV604_4"; |
| SIRV6 | LexogenSIRVData | exon | 2741 | 2828 | . | + | 0 | gene_id "SIRV6"; transcript_id "SIRV604"; exon_assignment "SIRV604_5"; |
| SIRV6 | LexogenSIRVData | exon | 3107 | 3164 | . | + | 0 | gene_id "SIRV6"; transcript_id "SIRV604"; exon_assignment "SIRV604_6"; |
| SIRV6 | LexogenSIRVData | exon | 10725 | 10818 | . | + | 0 | gene_id "SIRV6"; transcript_id "SIRV604"; exon_assignment "SIRV604_7"; |
| SIRV6 | LexogenSIRVData | exon | 11035 | 11108 | . | + | 0 | gene_id "SIRV6"; transcript_id "SIRV604"; exon_assignment "SIRV604_8"; |
| SIRV6 | LexogenSIRVData | exon | 11206 | 11837 | . | + | 0 | gene_id "SIRV6"; transcript_id "SIRV604"; exon_assignment "SIRV604_9"; |
| SIRV6 | LexogenSIRVData | exon | 2286 | 2620 | . | + | 0 | gene_id "SIRV6"; transcript_id "SIRV606"; exon_assignment "SIRV606_0"; |
| SIRV6 | LexogenSIRVData | exon | 2741 | 2828 | . | + | 0 | gene_id "SIRV6"; transcript_id "SIRV606"; exon_assignment "SIRV606_1"; |
| SIRV6 | LexogenSIRVData | exon | 3107 | 314 | . | + | 0 | gene_id "SIRV6"; transcript_id "SIRV606"; exon_assignment "SIRV606_2"; |
| SIRV6 | LexogenSIRVData | exon | 10725 | 10788 | . | + | 0 | gene_id "SIRV6"; transcript_id "SIRV606"; exon_assignment "SIRV606_3"; |
| SIRV6 | LexogenSIRVData | exon | 1131 | 1186 | . | + | 0 | gene_id "SIRV6"; transcript_id "SIRV607"; exon_assignment "SIRV607_0"; |
| SIRV6 | LexogenSIRVData | exon | 1469 | 1735 | . | + | 0 | gene_id "SIRV6"; transcript_id "SIRV607"; exon_assignment "SIRV607_1"; |
| SIRV6 | LexogenSIRVData | exon | 1846 | 2026 | . | + | 0 | gene_id "SIRV6"; transcript_id "SIRV607"; exon_assignment "SIRV607_2"; |
| SIRV6 | LexogenSIRVData | exon | 2471 | 2540 | . | + | 0 | gene_id "SIRV6"; transcript_id "SIRV607"; exon_assignment "SIRV607_3"; |
| SIRV6 | LexogenSIRVData | exon | 1138 | 1186 | . | + | 0 | gene_id "SIRV6"; transcript_id "SIRV609"; exon_assignment "SIRV609_0"; |
| SIRV6 | LexogenSIRVData | exon | 1469 | 1534 | . | + | 0 | gene_id "SIRV6"; transcript_id "SIRV609"; exon_assignment "SIRV609_1"; |
| SIRV6 | LexogenSIRVData | exon | 1641 | 1735 | . | + | 0 | gene_id "SIRV6"; transcript_id "SIRV609"; exon_assignment "SIRV609_2"; |

APPENDIX A-continued

GTFfileSIRVl

| | | | | | | | | |
|---|---|---|---|---|---|---|---|---|
| SIRV6 | LexogenSIRVData | exon | 1846 | 2120 | . | + | 0 | gene_id "SIRV6"; transcript_id "SIRV609"; exon_assignment "SIRV609_3"; |
| SIRV6 | LexogenSIRVData | exon | 2473 | 2620 | . | + | 0 | gene_id "SIRV6"; transcript_id "SIRV610"; exon_assignment "SIRV610_0"; |
| SIRV6 | LexogenSIRVData | exon | 2741 | 2828 | . | + | 0 | gene_id "SIRV6"; transcript_id "SIRV610"; exon_assignment "SIRV610_1"; |
| SIRV6 | LexogenSIRVData | exon | 3107 | 3164 | . | + | 0 | gene_id "SIRV6"; transcript_id "SIRV610"; exon_assignment "SIRV610_2"; |
| SIRV6 | LexogenSIRVData | exon | 10725 | 11108 | . | + | 0 | gene_id "SIRV6"; transcript_id "SIRV610"; exon_assignment "SIRV610_3"; |
| SIRV6 | LexogenSIRVData | exon | 11206 | 11690 | . | + | 0 | gene_id "SIRV6"; transcript_id "SIRV610"; exon_assignment "SIRV610_4"; |
| SIRV6 | LexogenSIRVData | exon | 1088 | 1186 | . | + | 0 | gene_id "SIRV6"; transcript_id "SIRV612"; exon_assignment "SIRV612_0"; |
| SIRV6 | LexogenSIRVData | exon | 1469 | 1534 | . | + | 0 | gene_id "SIRV6"; transcript_id "SIRV612"; exon_assignment "SIRV612_1"; |
| SIRV6 | LexogenSIRVData | exon | 1641 | 1735 | . | + | 0 | gene_id "SIRV6"; transcript_id "SIRV612"; exon_assignment "SIRV612_2"; |
| SIRV6 | LexogenSIRVData | exon | 1846 | 2026 | . | + | 0 | gene_id "SIRV6"; transcript_id "SIRV612"; exon_assignment "SIRV612_3"; |
| SIRV6 | LexogenSIRVData | exon | 2471 | 2620 | . | + | 0 | gene_id "SIRV6"; transcript_id "SIRV612"; exon_assignment "SIRV612_4"; |
| SIRV6 | LexogenSIRVData | exon | 2741 | 2828 | . | + | 0 | gene_id "SIRV6"; transcript_id "SIRV612"; exon_assignment "SIRV612_5"; |
| SIRV6 | LexogenSIRVData | exon | 3107 | 3164 | . | + | 0 | gene_id "SIRV6"; transcript_id "SIRV612"; exon_assignment "SIRV612_6"; |
| SIRV6 | LexogenSIRVData | exon | 10725 | 10818 | . | + | 0 | gene_id "SIRV6"; transcript_id "SIRV612"; exon_assignment "SIRV612_7"; |
| SIRV6 | LexogenSIRVData | exon | 11032 | 11108 | . | + | 0 | gene_id "SIRV6"; transcript_id "SIRV612"; exon_assignment "SIRV612_8"; |
| SIRV6 | LexogenSIRVData | exon | 11206 | 11825 | . | + | 0 | gene_id "SIRV6"; transcript_id "SIRV612"; exon_assignment "SIRV612_9"; |
| SIRV6 | LexogenSIRVData | exon | 3106 | 3164 | . | + | 0 | gene_id "SIRV6"; transcript_id "SIRV613"; exon_assignment "SIRV613_0"; |
| SIRV6 | LexogenSIRVData | exon | 7105 | 7448 | . | + | 0 | gene_id "SIRV6"; transcript_id "SIRV613"; exon_assignment "SIRV613_1"; |
| SIRV6 | LexogenSIRVData | exon | 7806 | 7923 | . | + | 0 | gene_id "SIRV6"; transcript_id "SIRV613"; exon_assignment "SIRV613_2"; |
| SIRV6 | LexogenSIRVData | exon | 10725 | 10818 | . | + | 0 | gene_id "SIRV6"; transcript_id "SIRV613"; exon_assignment "SIRV613_3"; |
| SIRV6 | LexogenSIRVData | exon | 11032 | 11108 | . | + | 0 | gene_id "SIRV6"; transcript_id "SIRV613"; exon_assignment "SIRV613_4"; |
| SIRV6 | LexogenSIRVData | exon | 11206 | 11824 | . | + | 0 | gene_id "SIRV6"; transcript_id "SIRV613"; exon_assignment "SIRV613_5"; |
| SIRV6 | LexogenSIRVData | exon | 2517 | 2620 | . | + | 0 | gene_id "SIRV6"; transcript_id "SIRV614"; exon_assignment "SIRV614_0"; |
| SIRV6 | LexogenSIRVData | exon | 2741 | 2828 | . | + | 0 | gene_id "SIRV6"; transcript_id "SIRV614"; exon_assignment "SIRV614_1"; |
| SIRV6 | LexogenSIRVData | exon | 3107 | 3164 | . | + | 0 | gene_id "SIRV6"; transcript_id "SIRV614"; exon_assignment "SIRV614_2"; |
| SIRV6 | LexogenSIRVData | exon | 7806 | 7923 | . | + | 0 | gene_id "SIRV6"; transcript_id "SIRV614"; exon_assignment "SIRV614_3"; |
| SIRV6 | LexogenSIRVData | exon | 10725 | 10815 | . | + | 0 | gene_id "SIRV6"; transcript_id "SIRV614"; exon_assignment "SIRV614_4"; |
| SIRV6 | LexogenSIRVData | exon | 1545 | 1820 | . | − | 0 | gene_id "SIRV6"; transcript_id "SIRV617"; exon_assignment "SIRV617_0"; |
| SIRV6 | LexogenSIRVData | exon | 2359 | 2547 | . | − | 0 | gene_id "SIRV6"; transcript_id "SIRV618"; exon_assignment "SIRV618_0"; |
| SIRV7 | LexogenSIRVData | exon | 1001 | 2675 | . | − | 0 | gene_id "SIRV7"; transcript_id "SIRV703"; exon_assignment "SIRV703_0"; |
| SIRV7 | LexogenSIRVData | exon | 2994 | 3111 | . | − | 0 | gene_id "SIRV7"; transcript_id "SIRV703"; exon_assignment "SIRV703_1"; |
| SIRV7 | LexogenSIRVData | exon | 3810 | 3896 | . | − | 0 | gene_id "SIRV7"; transcript_id "SIRV703"; exon_assignment "SIRV703_2"; |
| SIRV7 | LexogenSIRVData | exon | 114681 | 114988 | . | − | 0 | gene_id "SIRV7"; transcript_id "SIRV703"; exon_assignment "SIRV703_3"; |
| SIRV7 | LexogenSIRVData | exon | 147609 | 147918 | . | − | 0 | gene_id "SIRV7"; transcript_id "SIRV703"; exon_assignment "SIRV703_4"; |
| SIRV7 | LexogenSIRVData | exon | 55850 | 56097 | . | − | 0 | gene_id "SIRV7"; transcript_id "SIRV704"; exon_assignment "SIRV704_0"; |
| SIRV7 | LexogenSIRVData | exon | 78842 | 78963 | . | − | 0 | gene_id "SIRV7"; transcript_id "SIRV704"; exon_assignment "SIRV704_1"; |
| SIRV7 | LexogenSIRVData | exon | 114681 | 114738 | . | − | 0 | gene_id "SIRV7"; transcript_id "SIRV704"; exon_assignment "SIRV704_2"; |
| SIRV7 | LexogenSIRVData | exon | 1006 | 2675 | . | − | 0 | gene_id "SIRV7"; transcript_id "SIRV705"; exon_assignment "SIRV705_0"; |
| SIRV7 | LexogenSIRVData | exon | 2994 | 3111 | . | − | 0 | gene_id "SIRV7"; transcript_id "SIRV705"; exon_assignment "SIRV705_1"; |
| SIRV7 | LexogenSIRVData | exon | 43029 | 43077 | . | − | 0 | gene_id "SIRV7"; transcript_id "SIRV705"; exon_assignment "SIRV705_1"; |
| SIRV7 | LexogenSIRVData | exon | 114681 | 114988 | . | − | 0 | gene_id "SIRV7"; transcript_id "SIRV705"; exon_assignment "SIRV705_3"; |
| SIRV7 | LexogenSIRVData | exon | 147609 | 147925 | . | − | 0 | gene_id "SIRV7"; transcript_id "SIRV705"; exon_assignment "SIRV705_4"; |
| SIRV7 | LexogenSIRVData | exon | 56032 | 56097 | . | − | 0 | gene_id "SIRV7"; transcript_id "SIRV706"; exon_assignment "SIRV706_0"; |
| SIRV7 | LexogenSIRVData | exon | 70884 | 70987 | . | − | 0 | gene_id "SIRV7"; transcript_id "SIRV706"; exon_assignment "SIRV706_1"; |
| SIRV7 | LexogenSIRVData | exon | 78842 | 78963 | . | − | 0 | gene_id "SIRV7"; transcript_id "SIRV706"; exon_assignment "SIRV706_2"; |
| SIRV7 | LexogenSIRVData | exon | 114681 | 114988 | . | − | 0 | gene_id "SIRV7"; transcript_id "SIRV706"; exon_assignment "SIRV706_3"; |
| SIRV7 | LexogenSIRVData | exon | 147609 | 147957 | . | − | 0 | gene_id "SIRV7"; transcript_id "SIRV706"; exon_assignment "SIRV706_4"; |

APPENDIX B

GTF file SIRV C

| | | | | | | | | |
|---|---|---|---|---|---|---|---|---|
| SIRV1 | LexogenSIRVData | exon | 1001 | 1484 | . | − | 0 | gene_id "SIRV1"; transcript_id "SIRV101"; exon_assignment "SIRV101_0"; |
| SIRV1 | LexogenSIRVData | exon | 6338 | 6473 | . | − | 0 | gene_id "SIRV1"; transcript_id "SIRV101"; exon_assignment "SIRV101_1"; |
| SIRV1 | LexogenSIRVData | exon | 6561 | 6813 | . | − | 0 | gene_id "SIRV1"; transcript_id "SIRV101"; exon_assignment "SIRV101_2"; |
| SIRV1 | LexogenSIRVData | exon | 7553 | 7814 | . | − | 0 | gene_id "SIRV1"; transcript_id "SIRV101"; exon_assignment "SIRV101_3"; |
| SIRV1 | LexogenSIRVData | exon | 10283 | 10366 | . | − | 0 | gene_id "SIRV1"; transcript_id "SIRV101"; exon_assignment "SIRV101_4"; |
| SIRV1 | LexogenSIRVData | exon | 10445 | 10786 | . | − | 0 | gene_id "SIRV1"; transcript_id "SIRV101"; exon_assignment "SIRV101_5"; |
| SIRV1 | LexogenSIRVData | exon | 1007 | 1484 | . | − | 0 | gene_id "SIRV1"; transcript_id "SIRV102"; exon_assignment "SIRV102_0"; |
| SIRV1 | LexogenSIRVData | exon | 6338 | 6813 | . | − | 0 | gene_id "SIRV1"; transcript_id "SIRV102"; exon_assignment "SIRV102_1"; |
| SIRV1 | LexogenSIRVData | exon | 7553 | 7814 | . | − | 0 | gene_id "SIRV1"; transcript_id "SIRV102"; exon_assignment "SIRV102_2"; |
| SIRV1 | LexogenSIRVData | exon | 10283 | 10366 | . | − | 0 | gene_id "SIRV1"; transcript_id "SIRV102"; exon_assignment "SIRV102_3"; |
| SIRV1 | LexogenSIRVData | exon | 1001 | 1484 | . | − | 0 | gene_id "SIRV1"; transcript_id "SIRV103"; exon_assignment "SIRV103_0"; |
| SIRV1 | LexogenSIRVData | exon | 6338 | 6473 | . | − | 0 | gene_id "SIRV1"; transcript_id "SIRV103"; exon_assignment "SIRV103_1"; |
| SIRV1 | LexogenSIRVData | exon | 6561 | 6813 | . | − | 0 | gene_id "SIRV1"; transcript_id "SIRV103"; exon_assignment "SIRV103_2"; |
| SIRV1 | LexogenSIRVData | exon | 7553 | 7814 | . | − | 0 | gene_id "SIRV1"; transcript_id "SIRV103"; exon_assignment "SIRV103_3"; |
| SIRV1 | LexogenSIRVData | exon | 10283 | 10366 | . | − | 0 | gene_id "SIRV1"; transcript_id "SIRV103"; exon_assignment "SIRV103_4"; |
| SIRV1 | LexogenSIRVData | exon | 10648 | 10791 | . | − | 0 | gene_id "SIRV1"; transcript_id "SIRV103"; exon_assignment "SIRV103_5"; |
| SIRV1 | LexogenSIRVData | exon | 6450 | 6473 | . | − | 0 | gene_id "SIRV1"; transcript_id "SIRV105"; exon_assignment "SIRV105_0"; |
| SIRV1 | LexogenSIRVData | exon | 6561 | 6813 | . | − | 0 | gene_id "SIRV1"; transcript_id "SIRV105"; exon_assignment "SIRV105_1"; |
| SIRV1 | LexogenSIRVData | exon | 7553 | 7814 | . | − | 0 | gene_id "SIRV1"; transcript_id "SIRV105"; exon_assignment "SIRV105_2"; |
| SIRV1 | LexogenSIRVData | exon | 10283 | 10366 | . | − | 0 | gene_id "SIRV1"; transcript_id "SIRV105"; exon_assignment "SIRV105_3"; |
| SIRV1 | LexogenSIRVData | exon | 10594 | 10640 | . | − | 0 | gene_id "SIRV1"; transcript_id "SIRV105"; exon_assignment "SIRV105_4"; |
| SIRV1 | LexogenSIRVData | exon | 1001 | 1484 | . | − | 0 | gene_id "SIRV1"; transcript_id "SIRV106"; exon_assignment "SIRV106_0"; |
| SIRV1 | LexogenSIRVData | exon | 7553 | 7808 | . | − | 0 | gene_id "SIRV1"; transcript_id "SIRV106"; exon_assignment "SIRV106_1"; |

APPENDIX B-continued

GTF file SIRV C

| | | | | | | | | |
|---|---|---|---|---|---|---|---|---|
| SIRV1 | LexogenSIRVData | exon | 10554 | 10786 | . | − | 0 | gene_id "SIRV1"; transcript_id "SIRV106"; exon_assignment "SIRV106_2"; |
| SIRV1 | LexogenSIRVData | exon | 10648 | 10791 | . | − | 0 | gene_id "SIRV1"; transcript_id "SIRV107"; exon_assignment "SIRV107_0"; |
| SIRV1 | LexogenSIRVData | exon | 10883 | 11242 | . | − | 0 | gene_id "SIRV1"; transcript_id "SIRV107"; exon_assignment "SIRV107_1"; |
| SIRV1 | LexogenSIRVData | exon | 11404 | 11643 | . | − | 0 | gene_id "SIRV1"; transcript_id "SIRV107"; exon_assignment "SIRV107_2"; |
| SIRV1 | LexogenSIRVData | exon | 10583 | 10791 | . | + | 0 | gene_id "SIRV1"; transcript_id "SIRV108"; exon_assignment "SIRV108_0"; |
| SIRV1 | LexogenSIRVData | exon | 10898 | 11187 | . | + | 0 | gene_id "SIRV1"; transcript_id "SIRV108"; exon_assignment "SIRV108_1"; |
| SIRV1 | LexogenSIRVData | exon | 11404 | 11606 | . | + | 0 | gene_id "SIRV1"; transcript_id "SIRV108"; exon_assignment "SIRV108_2"; |
| SIRV1 | LexogenSIRVData | exon | 10712 | 10791 | . | + | 0 | gene_id "SIRV1"; transcript_id "SIRV109"; exon_assignment "SIRV109_0"; |
| SIRV1 | LexogenSIRVData | exon | 10883 | 11057 | . | + | 0 | gene_id "SIRV1"; transcript_id "SIRV109"; exon_assignment "SIRV109_1"; |
| SIRV1 | LexogenSIRVData | exon | 11435 | 11643 | . | + | 0 | gene_id "SIRV1"; transcript_id "SIRV109"; exon_assignment "SIRV109_2"; |
| SIRV2 | LexogenSIRVData | exon | 1001 | 1661 | . | − | 0 | gene_id "SIRV2"; transcript_id "SIRV201"; exon_assignment "SIRV201_0"; |
| SIRV2 | LexogenSIRVData | exon | 1742 | 1853 | . | − | 0 | gene_id "SIRV2"; transcript_id "SIRV201"; exon_assignment "SIRV201_1"; |
| SIRV2 | LexogenSIRVData | exon | 1974 | 2064 | . | − | 0 | gene_id "SIRV2"; transcript_id "SIRV201"; exon_assignment "SIRV201_2"; |
| SIRV2 | LexogenSIRVData | exon | 2675 | 2802 | . | − | 0 | gene_id "SIRV2"; transcript_id "SIRV201"; exon_assignment "SIRV201_3"; |
| SIRV2 | LexogenSIRVData | exon | 2882 | 3010 | . | − | 0 | gene_id "SIRV2"; transcript_id "SIRV201"; exon_assignment "SIRV201_4"; |
| SIRV2 | LexogenSIRVData | exon | 3106 | 3374 | . | − | 0 | gene_id "SIRV2"; transcript_id "SIRV201"; exon_assignment "SIRV201_5"; |
| SIRV2 | LexogenSIRVData | exon | 3666 | 3825 | . | − | 0 | gene_id "SIRV2"; transcript_id "SIRV201"; exon_assignment "SIRV201_6"; |
| SIRV2 | LexogenSIRVData | exon | 3967 | 4094 | . | − | 0 | gene_id "SIRV2"; transcript_id "SIRV201"; exon_assignment "SIRV201_7"; |
| SIRV2 | LexogenSIRVData | exon | 4339 | 4479 | . | − | 0 | gene_id "SIRV2"; transcript_id "SIRV201"; exon_assignment "SIRV201_8"; |
| SIRV2 | LexogenSIRVData | exon | 4688 | 4800 | . | − | 0 | gene_id "SIRV2"; transcript_id "SIRV201"; exon_assignment "SIRV201_9"; |
| SIRV2 | LexogenSIRVData | exon | 5789 | 5907 | . | − | 0 | gene_id "SIRV2"; transcript_id "SIRV201"; exon_assignment "SIRV201_10"; |
| SIRV2 | LexogenSIRVData | exon | 1036 | 1661 | . | − | 0 | gene_id "SIRV2"; transcript_id "SIRV202"; exon_assignment "SIRV202_0"; |
| SIRV2 | LexogenSIRVData | exon | 1742 | 1853 | . | − | 0 | gene_id "SIRV2"; transcript_id "SIRV202"; exon_assignment "SIRV202_1"; |
| SIRV2 | LexogenSIRVData | exon | 1974 | 2064 | . | − | 0 | gene_id "SIRV2"; transcript_id "SIRV202"; exon_assignment "SIRV202_2"; |
| SIRV2 | LexogenSIRVData | exon | 2675 | 2802 | . | − | 0 | gene_id "SIRV2"; transcript_id "SIRV202"; exon_assignment "SIRV202_3"; |
| SIRV2 | LexogenSIRVData | exon | 2882 | 3010 | . | − | 0 | gene_id "SIRV2"; transcript_id "SIRV202"; exon_assignment "SIRV202_4"; |
| SIRV2 | LexogenSIRVData | exon | 3106 | 3325 | . | − | 0 | gene_id "SIRV2"; transcript_id "SIRV202"; exon_assignment "SIRV202_5"; |
| SIRV2 | LexogenSIRVData | exon | 3666 | 3825 | . | − | 0 | gene_id "SIRV2"; transcript_id "SIRV202"; exon_assignment "SIRV202_6"; |
| SIRV2 | LexogenSIRVData | exon | 3967 | 4094 | . | − | 0 | gene_id "SIRV2"; transcript_id "SIRV202"; exon_assignment "SIRV202_7"; |
| SIRV2 | LexogenSIRVData | exon | 4339 | 4479 | . | − | 0 | gene_id "SIRV2"; transcript_id "SIRV202"; exon_assignment "SIRV202_8"; |
| SIRV2 | LexogenSIRVData | exon | 4688 | 4800 | . | − | 0 | gene_id "SIRV2"; transcript_id "SIRV202"; exon_assignment "SIRV202_9"; |
| SIRV2 | LexogenSIRVData | exon | 5789 | 5911 | . | − | 0 | gene_id "SIRV2"; transcript_id "SIRV202"; exon_assignment "SIRV202_10"; |
| SIRV2 | LexogenSIRVData | exon | 3666 | 3825 | . | − | 0 | gene_id "SIRV2"; transcript_id "SIRV203"; exon_assignment "SIRV203_0"; |
| SIRV2 | LexogenSIRVData | exon | 3967 | 4094 | . | − | 0 | gene_id "SIRV2"; transcript_id "SIRV203"; exon_assignment "SIRV203_1"; |
| SIRV2 | LexogenSIRVData | exon | 4339 | 4479 | . | − | 0 | gene_id "SIRV2"; transcript_id "SIRV203"; exon_assignment "SIRV203_2"; |
| SIRV2 | LexogenSIRVData | exon | 4688 | 4800 | . | − | 0 | gene_id "SIRV2"; transcript_id "SIRV203"; exon_assignment "SIRV203_3"; |
| SIRV2 | LexogenSIRVData | exon | 5752 | 5895 | . | − | 0 | gene_id "SIRV2"; transcript_id "SIRV203"; exon_assignment "SIRV203_4"; |
| SIRV2 | LexogenSIRVData | exon | 3644 | 3825 | . | − | 0 | gene_id "SIRV2"; transcript_id "SIRV204"; exon_assignment "SIRV204_0"; |
| SIRV2 | LexogenSIRVData | exon | 3967 | 4479 | . | − | 0 | gene_id "SIRV2"; transcript_id "SIRV204"; exon_assignment "SIRV204_1"; |
| SIRV2 | LexogenSIRVData | exon | 4688 | 4732 | . | − | 0 | gene_id "SIRV2"; transcript_id "SIRV204"; exon_assignment "SIRV204_2"; |
| SIRV2 | LexogenSIRVData | exon | 1109 | 1631 | . | + | 0 | gene_id "SIRV2"; transcript_id "SIRV205"; exon_assignment "SIRV205_0"; |
| SIRV2 | LexogenSIRVData | exon | 4034 | 4457 | . | + | 0 | gene_id "SIRV2"; transcript_id "SIRV206"; exon_assignment "SIRV206_0"; |
| SIRV3 | LexogenSIRVData | exon | 1945 | 2005 | . | + | 0 | gene_id "SIRV3"; transcript_id "SIRV301"; exon_assignment "SIRV301_0"; |
| SIRV3 | LexogenSIRVData | exon | 4569 | 4779 | . | + | 0 | gene_id "SIRV3"; transcript_id "SIRV301"; exon_assignment "SIRV301_1"; |
| SIRV3 | LexogenSIRVData | exon | 6058 | 7988 | . | + | 0 | gene_id "SIRV3"; transcript_id "SIRV301"; exon_assignment "SIRV301_2"; |
| SIRV3 | LexogenSIRVData | exon | 8128 | 8207 | . | + | 0 | gene_id "SIRV3"; transcript_id "SIRV301"; exon_assignment "SIRV301_3"; |
| SIRV3 | LexogenSIRVData | exon | 8756 | 8939 | . | + | 0 | gene_id "SIRV3"; transcript_id "SIRV301"; exon_assignment "SIRV301_4"; |
| SIRV3 | LexogenSIRVData | exon | 1964 | 2005 | . | + | 0 | gene_id "SIRV3"; transcript_id "SIRV302"; exon_assignment "SIRV302_0"; |
| SIRV3 | LexogenSIRVData | exon | 6058 | 7822 | . | + | 0 | gene_id "SIRV3"; transcript_id "SIRV302"; exon_assignment "SIRV302_1"; |
| SIRV3 | LexogenSIRVData | exon | 1964 | 2005 | . | + | 0 | gene_id "SIRV3"; transcript_id "SIRV303"; exon_assignment "SIRV303_0"; |
| SIRV3 | LexogenSIRVData | exon | 4569 | 4779 | . | + | 0 | gene_id "SIRV3"; transcript_id "SIRV303"; exon_assignment "SIRV303_1"; |
| SIRV3 | LexogenSIRVData | exon | 6058 | 7822 | . | + | 0 | gene_id "SIRV3"; transcript_id "SIRV303"; exon_assignment "SIRV303_2"; |
| SIRV3 | LexogenSIRVData | exon | 1964 | 2005 | . | + | 0 | gene_id "SIRV3"; transcript_id "SIRV304"; exon_assignment "SIRV304_0"; |
| SIRV3 | LexogenSIRVData | exon | 4004 | 4080 | . | + | 0 | gene_id "SIRV3"; transcript_id "SIRV304"; exon_assignment "SIRV304_1"; |
| SIRV3 | LexogenSIRVData | exon | 4569 | 4779 | . | + | 0 | gene_id "SIRV3"; transcript_id "SIRV304"; exon_assignment "SIRV304_2"; |
| SIRV3 | LexogenSIRVData | exon | 6058 | 6333 | . | + | 0 | gene_id "SIRV3"; transcript_id "SIRV304"; exon_assignment "SIRV304_3"; |
| SIRV3 | LexogenSIRVData | exon | 7271 | 7366 | . | + | 0 | gene_id "SIRV3"; transcript_id "SIRV304"; exon_assignment "SIRV304_4"; |
| SIRV3 | LexogenSIRVData | exon | 7873 | 7988 | . | + | 0 | gene_id "SIRV3"; transcript_id "SIRV304"; exon_assignment "SIRV304_5"; |
| SIRV3 | LexogenSIRVData | exon | 8125 | 8207 | . | + | 0 | gene_id "SIRV3"; transcript_id "SIRV304"; exon_assignment "SIRV304_6"; |
| SIRV3 | LexogenSIRVData | exon | 8756 | 8937 | . | + | 0 | gene_id "SIRV3"; transcript_id "SIRV304"; exon_assignment "SIRV304_7"; |
| SIRV3 | LexogenSIRVData | exon | 4004 | 4080 | . | + | 0 | gene_id "SIRV3"; transcript_id "SIRV305"; exon_assignment "SIRV305_0"; |
| SIRV3 | LexogenSIRVData | exon | 4569 | 4779 | . | + | 0 | gene_id "SIRV3"; transcript_id "SIRV305"; exon_assignment "SIRV305_1"; |
| SIRV3 | LexogenSIRVData | exon | 6571 | 6718 | . | + | 0 | gene_id "SIRV3"; transcript_id "SIRV305"; exon_assignment "SIRV305_2"; |
| SIRV3 | LexogenSIRVData | exon | 1945 | 2005 | . | + | 0 | gene_id "SIRV3"; transcript_id "SIRV306"; exon_assignment "SIRV306_0"; |
| SIRV3 | LexogenSIRVData | exon | 4004 | 4080 | . | + | 0 | gene_id "SIRV3"; transcript_id "SIRV306"; exon_assignment "SIRV306_1"; |
| SIRV3 | LexogenSIRVData | exon | 6058 | 8292 | . | + | 0 | gene_id "SIRV3"; transcript_id "SIRV306"; exon_assignment "SIRV306_2"; |
| SIRV3 | LexogenSIRVData | exon | 1964 | 2005 | . | + | 0 | gene_id "SIRV3"; transcript_id "SIRV307"; exon_assignment "SIRV307_0"; |
| SIRV3 | LexogenSIRVData | exon | 4004 | 4080 | . | + | 0 | gene_id "SIRV3"; transcript_id "SIRV307"; exon_assignment "SIRV307_1"; |
| SIRV3 | LexogenSIRVData | exon | 4575 | 4774 | . | + | 0 | gene_id "SIRV3"; transcript_id "SIRV307"; exon_assignment "SIRV307_2"; |
| SIRV3 | LexogenSIRVData | exon | 6058 | 6333 | . | + | 0 | gene_id "SIRV3"; transcript_id "SIRV307"; exon_assignment "SIRV307_3"; |
| SIRV3 | LexogenSIRVData | exon | 8756 | 8939 | . | + | 0 | gene_id "SIRV3"; transcript_id "SIRV307"; exon_assignment "SIRV307_4"; |
| SIRV3 | LexogenSIRVData | exon | 1001 | 1167 | . | − | 0 | gene_id "SIRV3"; transcript_id "SIRV308"; exon_assignment "SIRV308_0"; |
| SIRV3 | LexogenSIRVData | exon | 1533 | 1764 | . | − | 0 | gene_id "SIRV3"; transcript_id "SIRV308"; exon_assignment "SIRV308_1"; |
| SIRV3 | LexogenSIRVData | exon | 1903 | 1982 | . | − | 0 | gene_id "SIRV3"; transcript_id "SIRV308"; exon_assignment "SIRV308_2"; |
| SIRV3 | LexogenSIRVData | exon | 8798 | 8975 | . | − | 0 | gene_id "SIRV3"; transcript_id "SIRV309"; exon_assignment "SIRV309_0"; |
| SIRV3 | LexogenSIRVData | exon | 9190 | 9298 | . | − | 0 | gene_id "SIRV3"; transcript_id "SIRV309"; exon_assignment "SIRV309_1"; |
| SIRV3 | LexogenSIRVData | exon | 9435 | 9943 | . | − | 0 | gene_id "SIRV3"; transcript_id "SIRV309"; exon_assignment "SIRV309_2"; |
| SIRV3 | LexogenSIRVData | exon | 8760 | 8966 | . | − | 0 | gene_id "SIRV3"; transcript_id "SIRV310"; exon_assignment "SIRV310_0"; |

APPENDIX B-continued

GTF file SIRV C

| | | | | | | | | |
|---|---|---|---|---|---|---|---|---|
| SIRV3 | LexogenSIRVData | exon | 9190 | 9324 | . | − | 0 | gene_id "SIRV3"; transcript_id "SIRV310"; exon_assignment "SIRV310_1"; |
| SIRV3 | LexogenSIRVData | exon | 9668 | 9914 | . | − | 0 | gene_id "SIRV3"; transcript_id "SIRV310"; exon_assignment "SIRV310_2"; |
| SIRV3 | LexogenSIRVData | exon | 4602 | 4762 | . | − | 0 | gene_id "SIRV3"; transcript_id "SIRV311"; exon_assignment "SIRV311_0"; |
| SIRV4 | LexogenSIRVData | exon | 8323 | 8372 | . | − | 0 | gene_id "SIRV4"; transcript_id "SIRV403"; exon_assignment "SIRV403_0"; |
| SIRV4 | LexogenSIRVData | exon | 8630 | 8990 | . | − | 0 | gene_id "SIRV4"; transcript_id "SIRV403"; exon_assignment "SIRV403_1"; |
| SIRV4 | LexogenSIRVData | exon | 13673 | 13828 | . | − | 0 | gene_id "SIRV4"; transcript_id "SIRV403"; exon_assignment "SIRV403_2"; |
| SIRV4 | LexogenSIRVData | exon | 15020 | 15122 | . | − | 0 | gene_id "SIRV4"; transcript_id "SIRV403"; exon_assignment "SIRV403_3"; |
| SIRV4 | LexogenSIRVData | exon | 8323 | 8372 | . | − | 0 | gene_id "SIRV4"; transcript_id "SIRV404"; exon_assignment "SIRV404_0"; |
| SIRV4 | LexogenSIRVData | exon | 8630 | 8990 | . | − | 0 | gene_id "SIRV4"; transcript_id "SIRV404"; exon_assignment "SIRV404_1"; |
| SIRV4 | LexogenSIRVData | exon | 13673 | 13822 | . | − | 0 | gene_id "SIRV4"; transcript_id "SIRV404"; exon_assignment "SIRV404_2"; |
| SIRV4 | LexogenSIRVData | exon | 14593 | 14623 | . | − | 0 | gene_id "SIRV4"; transcript_id "SIRV404"; exon_assignment "SIRV404_3"; |
| SIRV4 | LexogenSIRVData | exon | 8630 | 8990 | . | − | 0 | gene_id "SIRV4"; transcript_id "SIRV405"; exon_assignment "SIRV405_0"; |
| SIRV4 | LexogenSIRVData | exon | 13673 | 13937 | . | − | 0 | gene_id "SIRV4"; transcript_id "SIRV405"; exon_assignment "SIRV405_1"; |
| SIRV4 | LexogenSIRVData | exon | 3638 | 4103 | . | − | 0 | gene_id "SIRV4"; transcript_id "SIRV406"; exon_assignment "SIRV406_0"; |
| SIRV4 | LexogenSIRVData | exon | 5008 | 5158 | . | − | 0 | gene_id "SIRV4"; transcript_id "SIRV406"; exon_assignment "SIRV406_1"; |
| SIRV4 | LexogenSIRVData | exon | 8324 | 8372 | . | − | 0 | gene_id "SIRV4"; transcript_id "SIRV408"; exon_assignment "SIRV408_0"; |
| SIRV4 | LexogenSIRVData | exon | 8630 | 8747 | . | − | 0 | gene_id "SIRV4"; transcript_id "SIRV408"; exon_assignment "SIRV408_1"; |
| SIRV4 | LexogenSIRVData | exon | 8847 | 8990 | . | − | 0 | gene_id "SIRV4"; transcript_id "SIRV408"; exon_assignment "SIRV408_2"; |
| SIRV4 | LexogenSIRVData | exon | 13673 | 13828 | . | − | 0 | gene_id "SIRV4"; transcript_id "SIRV408"; exon_assignment "SIRV408_3"; |
| SIRV4 | LexogenSIRVData | exon | 15020 | 15122 | . | − | 0 | gene_id "SIRV4"; transcript_id "SIRV408"; exon_assignment "SIRV408_4"; |
| SIRV4 | LexogenSIRVData | exon | 1001 | 1346 | . | + | 0 | gene_id "SIRV4"; transcript_id "SIRV409"; exon_assignment "SIRV409_0"; |
| SIRV4 | LexogenSIRVData | exon | 1679 | 1885 | . | + | 0 | gene_id "SIRV4"; transcript_id "SIRV409"; exon_assignment "SIRV409_1"; |
| SIRV4 | LexogenSIRVData | exon | 2390 | 3403 | . | + | 0 | gene_id "SIRV4"; transcript_id "SIRV409"; exon_assignment "SIRV409_2"; |
| SIRV4 | LexogenSIRVData | exon | 1456 | 1885 | . | + | 0 | gene_id "SIRV4"; transcript_id "SIRV410"; exon_assignment "SIRV410_0"; |
| SIRV4 | LexogenSIRVData | exon | 2252 | 2771 | . | + | 0 | gene_id "SIRV4"; transcript_id "SIRV410"; exon_assignment "SIRV410_1"; |
| SIRV5 | LexogenSIRVData | exon | 1057 | 1149 | . | + | 0 | gene_id "SIRV5"; transcript_id "SIRV501"; exon_assignment "SIRV501_0"; |
| SIRV5 | LexogenSIRVData | exon | 1988 | 2033 | . | + | 0 | gene_id "SIRV5"; transcript_id "SIRV501"; exon_assignment "SIRV501_1"; |
| SIRV5 | LexogenSIRVData | exon | 2120 | 2315 | . | + | 0 | gene_id "SIRV5"; transcript_id "SIRV501"; exon_assignment "SIRV501_2"; |
| SIRV5 | LexogenSIRVData | exon | 3299 | 3404 | . | + | 0 | gene_id "SIRV5"; transcript_id "SIRV501"; exon_assignment "SIRV501_3"; |
| SIRV5 | LexogenSIRVData | exon | 3484 | 3643 | . | + | 0 | gene_id "SIRV5"; transcript_id "SIRV501"; exon_assignment "SIRV501_4"; |
| SIRV5 | LexogenSIRVData | exon | 5381 | 5450 | . | + | 0 | gene_id "SIRV5"; transcript_id "SIRV501"; exon_assignment "SIRV501_5"; |
| SIRV5 | LexogenSIRVData | exon | 5544 | 5626 | . | + | 0 | gene_id "SIRV5"; transcript_id "SIRV501"; exon_assignment "SIRV501_6"; |
| SIRV5 | LexogenSIRVData | exon | 6112 | 6169 | . | + | 0 | gene_id "SIRV5"; transcript_id "SIRV501"; exon_assignment "SIRV501_7"; |
| SIRV5 | LexogenSIRVData | exon | 6328 | 6452 | . | + | 0 | gene_id "SIRV5"; transcript_id "SIRV501"; exon_assignment "SIRV501_8"; |
| SIRV5 | LexogenSIRVData | exon | 6659 | 6722 | . | + | 0 | gene_id "SIRV5"; transcript_id "SIRV501"; exon_assignment "SIRV501_9"; |
| SIRV5 | LexogenSIRVData | exon | 6827 | 6957 | . | + | 0 | gene_id "SIRV5"; transcript_id "SIRV501"; exon_assignment "SIRV501_10"; |
| SIRV5 | LexogenSIRVData | exon | 7145 | 7307 | . | + | 0 | gene_id "SIRV5"; transcript_id "SIRV501"; exon_assignment "SIRV501_11"; |
| SIRV5 | LexogenSIRVData | exon | 7682 | 7762 | . | + | 0 | gene_id "SIRV5"; transcript_id "SIRV501"; exon_assignment "SIRV501_12"; |
| SIRV5 | LexogenSIRVData | exon | 7871 | 8016 | . | + | 0 | gene_id "SIRV5"; transcript_id "SIRV501"; exon_assignment "SIRV501_13"; |
| SIRV5 | LexogenSIRVData | exon | 8278 | 8381 | . | + | 0 | gene_id "SIRV5"; transcript_id "SIRV501"; exon_assignment "SIRV501_14"; |
| SIRV5 | LexogenSIRVData | exon | 8455 | 8585 | . | + | 0 | gene_id "SIRV5"; transcript_id "SIRV501"; exon_assignment "SIRV501_15"; |
| SIRV5 | LexogenSIRVData | exon | 10859 | 10991 | . | + | 0 | gene_id "SIRV5"; transcript_id "SIRV501"; exon_assignment "SIRV501_16"; |
| SIRV5 | LexogenSIRVData | exon | 1020 | 1149 | . | + | 0 | gene_id "SIRV5"; transcript_id "SIRV502"; exon_assignment "SIRV502_0"; |
| SIRV5 | LexogenSIRVData | exon | 1988 | 2033 | . | + | 0 | gene_id "SIRV5"; transcript_id "SIRV502"; exon_assignment "SIRV502_1"; |
| SIRV5 | LexogenSIRVData | exon | 2120 | 2156 | . | + | 0 | gene_id "SIRV5"; transcript_id "SIRV502"; exon_assignment "SIRV502_2"; |
| SIRV5 | LexogenSIRVData | exon | 2271 | 2488 | . | + | 0 | gene_id "SIRV5"; transcript_id "SIRV502"; exon_assignment "SIRV502_3"; |
| SIRV5 | LexogenSIRVData | exon | 3299 | 3404 | . | + | 0 | gene_id "SIRV5"; transcript_id "SIRV502"; exon_assignment "SIRV502_4"; |
| SIRV5 | LexogenSIRVData | exon | 3484 | 3643 | . | + | 0 | gene_id "SIRV5"; transcript_id "SIRV502"; exon_assignment "SIRV502_5"; |
| SIRV5 | LexogenSIRVData | exon | 5381 | 5450 | . | + | 0 | gene_id "SIRV5"; transcript_id "SIRV502"; exon_assignment "SIRV502_6"; |
| SIRV5 | LexogenSIRVData | exon | 5544 | 5626 | . | + | 0 | gene_id "SIRV5"; transcript_id "SIRV502"; exon_assignment "SIRV502_7"; |
| SIRV5 | LexogenSIRVData | exon | 6112 | 6169 | . | + | 0 | gene_id "SIRV5"; transcript_id "SIRV502"; exon_assignment "SIRV502_8"; |
| SIRV5 | LexogenSIRVData | exon | 6328 | 6452 | . | + | 0 | gene_id "SIRV5"; transcript_id "SIRV502"; exon_assignment "SIRV502_9"; |
| SIRV5 | LexogenSIRVData | exon | 6659 | 6722 | . | + | 0 | gene_id "SIRV5"; transcript_id "SIRV502"; exon_assignment "SIRV502_10"; |
| SIRV5 | LexogenSIRVData | exon | 6827 | 6957 | . | + | 0 | gene_id "SIRV5"; transcript_id "SIRV502"; exon_assignment "SIRV502_11"; |
| SIRV5 | LexogenSIRVData | exon | 7145 | 7307 | . | + | 0 | gene_id "SIRV5"; transcript_id "SIRV502"; exon_assignment "SIRV502_12"; |
| SIRV5 | LexogenSIRVData | exon | 7682 | 7762 | . | + | 0 | gene_id "SIRV5"; transcript_id "SIRV502"; exon_assignment "SIRV502_13"; |
| SIRV5 | LexogenSIRVData | exon | 7871 | 8016 | . | + | 0 | gene_id "SIRV5"; transcript_id "SIRV502"; exon_assignment "SIRV502_14"; |
| SIRV5 | LexogenSIRVData | exon | 8278 | 8381 | . | + | 0 | gene_id "SIRV5"; transcript_id "SIRV502"; exon_assignment "SIRV502_15"; |
| SIRV5 | LexogenSIRVData | exon | 8455 | 8585 | . | + | 0 | gene_id "SIRV5"; transcript_id "SIRV502"; exon_assignment "SIRV502_16"; |
| SIRV5 | LexogenSIRVData | exon | 10859 | 10989 | . | + | 0 | gene_id "SIRV5"; transcript_id "SIRV502"; exon_assignment "SIRV502_17"; |
| SIRV5 | LexogenSIRVData | exon | 8202 | 8585 | . | + | 0 | gene_id "SIRV5"; transcript_id "SIRV503"; exon_assignment "SIRV503_0"; |
| SIRV5 | LexogenSIRVData | exon | 10859 | 10991 | . | + | 0 | gene_id "SIRV5"; transcript_id "SIRV503"; exon_assignment "SIRV503_1"; |
| SIRV5 | LexogenSIRVData | exon | 11134 | 11142 | . | + | 0 | gene_id "SIRV5"; transcript_id "SIRV503"; exon_assignment "SIRV503_2"; |
| SIRV5 | LexogenSIRVData | exon | 11134 | 13606 | . | + | 0 | gene_id "SIRV5"; transcript_id "SIRV504"; exon_assignment "SIRV504_0"; |
| SIRV5 | LexogenSIRVData | exon | 1001 | 1149 | . | + | 0 | gene_id "SIRV5"; transcript_id "SIRV505"; exon_assignment "SIRV505_0"; |
| SIRV5 | LexogenSIRVData | exon | 1988 | 2033 | . | + | 0 | gene_id "SIRV5"; transcript_id "SIRV505"; exon_assignment "SIRV505_1"; |
| SIRV5 | LexogenSIRVData | exon | 2120 | 2156 | . | + | 0 | gene_id "SIRV5"; transcript_id "SIRV505"; exon_assignment "SIRV505_2"; |
| SIRV5 | LexogenSIRVData | exon | 2271 | 2315 | . | + | 0 | gene_id "SIRV5"; transcript_id "SIRV505"; exon_assignment "SIRV505_3"; |
| SIRV5 | LexogenSIRVData | exon | 3299 | 3404 | . | + | 0 | gene_id "SIRV5"; transcript_id "SIRV505"; exon_assignment "SIRV505_4"; |
| SIRV5 | LexogenSIRVData | exon | 3484 | 3643 | . | + | 0 | gene_id "SIRV5"; transcript_id "SIRV505"; exon_assignment "SIRV505_5"; |
| SIRV5 | LexogenSIRVData | exon | 5381 | 5450 | . | + | 0 | gene_id "SIRV5"; transcript_id "SIRV505"; exon_assignment "SIRV505_6"; |
| SIRV5 | LexogenSIRVData | exon | 5544 | 5626 | . | + | 0 | gene_id "SIRV5"; transcript_id "SIRV505"; exon_assignment "SIRV505_7"; |
| SIRV5 | LexogenSIRVData | exon | 6112 | 6169 | . | + | 0 | gene_id "SIRV5"; transcript_id "SIRV505"; exon_assignment "SIRV505_8"; |
| SIRV5 | LexogenSIRVData | exon | 6328 | 6452 | . | + | 0 | gene_id "SIRV5"; transcript_id "SIRV505"; exon_assignment "SIRV505_9"; |
| SIRV5 | LexogenSIRVData | exon | 6827 | 6957 | . | + | 0 | gene_id "SIRV5"; transcript_id "SIRV505"; exon_assignment "SIRV505_10"; |
| SIRV5 | LexogenSIRVData | exon | 7145 | 7307 | . | + | 0 | gene_id "SIRV5"; transcript_id "SIRV505"; exon_assignment "SIRV505_11"; |
| SIRV5 | LexogenSIRVData | exon | 7682 | 7762 | . | + | 0 | gene_id "SIRV5"; transcript_id "SIRV505"; exon_assignment "SIRV505_12"; |
| SIRV5 | LexogenSIRVData | exon | 7871 | 8381 | . | + | 0 | gene_id "SIRV5"; transcript_id "SIRV505"; exon_assignment "SIRV505_13"; |

APPENDIX B-continued

GTF file SIRV C

| | | | | | | | | |
|---|---|---|---|---|---|---|---|---|
| SIRV5 | LexogenSIRVData | exon | 8455 | 8585 | . | + | 0 | gene_id "SIRV5"; transcript_id "SIRV505"; exon_assignment "SIRV505_14"; |
| SIRV5 | LexogenSIRVData | exon | 10859 | 10991 | . | + | 0 | gene_id "SIRV5"; transcript_id "SIRV505"; exon_assignment "SIRV505_15"; |
| SIRV5 | LexogenSIRVData | exon | 1009 | 1149 | . | + | 0 | gene_id "SIRV5"; transcript_id "SIRV506"; exon_assignment "SIRV506_0"; |
| SIRV5 | LexogenSIRVData | exon | 1988 | 2398 | . | + | 0 | gene_id "SIRV5"; transcript_id "SIRV506"; exon_assignment "SIRV506_1"; |
| SIRV5 | LexogenSIRVData | exon | 1028 | 1149 | . | + | 0 | gene_id "SIRV5"; transcript_id "SIRV507"; exon_assignment "SIRV507_0"; |
| SIRV5 | LexogenSIRVData | exon | 1926 | 2033 | . | + | 0 | gene_id "SIRV5"; transcript_id "SIRV507"; exon_assignment "SIRV507_1"; |
| SIRV5 | LexogenSIRVData | exon | 2120 | 2156 | . | + | 0 | gene_id "SIRV5"; transcript_id "SIRV507"; exon_assignment "SIRV507_2"; |
| SIRV5 | LexogenSIRVData | exon | 2271 | 2315 | . | + | 0 | gene_id "SIRV5"; transcript_id "SIRV507"; exon_assignment "SIRV507_3"; |
| SIRV5 | LexogenSIRVData | exon | 3299 | 3404 | . | + | 0 | gene_id "SIRV5"; transcript_id "SIRV507"; exon_assignment "SIRV507_4"; |
| SIRV5 | LexogenSIRVData | exon | 3484 | 3598 | . | + | 0 | gene_id "SIRV5"; transcript_id "SIRV507"; exon_assignment "SIRV507_5"; |
| SIRV5 | LexogenSIRVData | exon | 1009 | 1149 | . | + | 0 | gene_id "SIRV5"; transcript_id "SIRV508"; exon_assignment "SIRV508_0"; |
| SIRV5 | LexogenSIRVData | exon | 1988 | 2033 | . | + | 0 | gene_id "SIRV5"; transcript_id "SIRV508"; exon_assignment "SIRV508_1"; |
| SIRV5 | LexogenSIRVData | exon | 2120 | 2156 | . | + | 0 | gene_id "SIRV5"; transcript_id "SIRV508"; exon_assignment "SIRV508_2"; |
| SIRV5 | LexogenSIRVData | exon | 2271 | 2315 | . | + | 0 | gene_id "SIRV5"; transcript_id "SIRV508"; exon_assignment "SIRV508_3"; |
| SIRV5 | LexogenSIRVData | exon | 3299 | 3404 | . | + | 0 | gene_id "SIRV5"; transcript_id "SIRV508"; exon_assignment "SIRV508_4"; |
| SIRV5 | LexogenSIRVData | exon | 3484 | 3643 | . | + | 0 | gene_id "SIRV5"; transcript_id "SIRV508"; exon_assignment "SIRV508_5"; |
| SIRV5 | LexogenSIRVData | exon | 5381 | 5450 | . | + | 0 | gene_id "SIRV5"; transcript_id "SIRV508"; exon_assignment "SIRV508_6"; |
| SIRV5 | LexogenSIRVData | exon | 5544 | 5626 | . | + | 0 | gene_id "SIRV5"; transcript_id "SIRV508"; exon_assignment "SIRV508_7"; |
| SIRV5 | LexogenSIRVData | exon | 6112 | 6169 | . | + | 0 | gene_id "SIRV5"; transcript_id "SIRV508"; exon_assignment "SIRV508_8"; |
| SIRV5 | LexogenSIRVData | exon | 6328 | 6452 | . | + | 0 | gene_id "SIRV5"; transcript_id "SIRV508"; exon_assignment "SIRV508_9"; |
| SIRV5 | LexogenSIRVData | exon | 6659 | 6722 | . | + | 0 | gene_id "SIRV5"; transcript_id "SIRV508"; exon_assignment "SIRV508_10"; |
| SIRV5 | LexogenSIRVData | exon | 6827 | 6957 | . | + | 0 | gene_id "SIRV5"; transcript_id "SIRV508"; exon_assignment "SIRV508_11"; |
| SIRV5 | LexogenSIRVData | exon | 7145 | 7307 | . | + | 0 | gene_id "SIRV5"; transcript_id "SIRV508"; exon_assignment "SIRV508_12"; |
| SIRV5 | LexogenSIRVData | exon | 7682 | 7762 | . | + | 0 | gene_id "SIRV5"; transcript_id "SIRV508"; exon_assignment "SIRV508_13"; |
| SIRV5 | LexogenSIRVData | exon | 7871 | 8381 | . | + | 0 | gene_id "SIRV5"; transcript_id "SIRV508"; exon_assignment "SIRV508_14"; |
| SIRV5 | LexogenSIRVData | exon | 8455 | 8585 | . | + | 0 | gene_id "SIRV5"; transcript_id "SIRV508"; exon_assignment "SIRV508_15"; |
| SIRV5 | LexogenSIRVData | exon | 10859 | 10991 | . | + | 0 | gene_id "SIRV5"; transcript_id "SIRV508"; exon_assignment "SIRV508_16"; |
| SIRV5 | LexogenSIRVData | exon | 8316 | 8381 | . | + | 0 | gene_id "SIRV5"; transcript_id "SIRV509"; exon_assignment "SIRV509_0"; |
| SIRV5 | LexogenSIRVData | exon | 8455 | 8585 | . | + | 0 | gene_id "SIRV5"; transcript_id "SIRV509"; exon_assignment "SIRV509_1"; |
| SIRV5 | LexogenSIRVData | exon | 10859 | 10991 | . | + | 0 | gene_id "SIRV5"; transcript_id "SIRV509"; exon_assignment "SIRV509_2"; |
| SIRV5 | LexogenSIRVData | exon | 11312 | 11866 | . | + | 0 | gene_id "SIRV5"; transcript_id "SIRV509"; exon_assignment "SIRV509_3"; |
| SIRV5 | LexogenSIRVData | exon | 1029 | 1149 | . | + | 0 | gene_id "SIRV5"; transcript_id "SIRV510"; exon_assignment "SIRV510_0"; |
| SIRV5 | LexogenSIRVData | exon | 1988 | 2033 | . | + | 0 | gene_id "SIRV5"; transcript_id "SIRV510"; exon_assignment "SIRV510_1"; |
| SIRV5 | LexogenSIRVData | exon | 2120 | 2156 | . | + | 0 | gene_id "SIRV5"; transcript_id "SIRV510"; exon_assignment "SIRV510_2"; |
| SIRV5 | LexogenSIRVData | exon | 2271 | 2315 | . | + | 0 | gene_id "SIRV5"; transcript_id "SIRV510"; exon_assignment "SIRV510_3"; |
| SIRV5 | LexogenSIRVData | exon | 3299 | 3404 | . | + | 0 | gene_id "SIRV5"; transcript_id "SIRV510"; exon_assignment "SIRV510_4"; |
| SIRV5 | LexogenSIRVData | exon | 3484 | 3643 | . | + | 0 | gene_id "SIRV5"; transcript_id "SIRV510"; exon_assignment "SIRV510_5"; |
| SIRV5 | LexogenSIRVData | exon | 5381 | 5450 | . | + | 0 | gene_id "SIRV5"; transcript_id "SIRV510"; exon_assignment "SIRV510_6"; |
| SIRV5 | LexogenSIRVData | exon | 5544 | 5626 | . | + | 0 | gene_id "SIRV5"; transcript_id "SIRV510"; exon_assignment "SIRV510_7"; |
| SIRV5 | LexogenSIRVData | exon | 6112 | 6169 | . | + | 0 | gene_id "SIRV5"; transcript_id "SIRV510"; exon_assignment "SIRV510_8"; |
| SIRV5 | LexogenSIRVData | exon | 6328 | 6452 | . | + | 0 | gene_id "SIRV5"; transcript_id "SIRV510"; exon_assignment "SIRV510_9"; |
| SIRV5 | LexogenSIRVData | exon | 6827 | 6957 | . | + | 0 | gene_id "SIRV5"; transcript_id "SIRV510"; exon_assignment "SIRV510_10"; |
| SIRV5 | LexogenSIRVData | exon | 7145 | 7307 | . | + | 0 | gene_id "SIRV5"; transcript_id "SIRV510"; exon_assignment "SIRV510_11"; |
| SIRV5 | LexogenSIRVData | exon | 7682 | 7762 | . | + | 0 | gene_id "SIRV5"; transcript_id "SIRV510"; exon_assignment "SIRV510_12"; |
| SIRV5 | LexogenSIRVData | exon | 7871 | 8016 | . | + | 0 | gene_id "SIRV5"; transcript_id "SIRV510"; exon_assignment "SIRV510_13"; |
| SIRV5 | LexogenSIRVData | exon | 8278 | 8381 | . | + | 0 | gene_id "SIRV5"; transcript_id "SIRV510"; exon_assignment "SIRV510_14"; |
| SIRV5 | LexogenSIRVData | exon | 8455 | 8585 | . | + | 0 | gene_id "SIRV5"; transcript_id "SIRV510"; exon_assignment "SIRV510_15"; |
| SIRV5 | LexogenSIRVData | exon | 10859 | 10991 | . | + | 0 | gene_id "SIRV5"; transcript_id "SIRV510"; exon_assignment "SIRV510_16"; |
| SIRV5 | LexogenSIRVData | exon | 11134 | 11867 | . | + | 0 | gene_id "SIRV5"; transcript_id "SIRV510"; exon_assignment "SIRV510_17"; |
| SIRV5 | LexogenSIRVData | exon | 1009 | 1143 | . | + | 0 | gene_id "SIRV5"; transcript_id "SIRV511"; exon_assignment "SIRV511_0"; |
| SIRV5 | LexogenSIRVData | exon | 1988 | 2398 | . | + | 0 | gene_id "SIRV5"; transcript_id "SIRV511"; exon_assignment "SIRV511_1"; |
| SIRV5 | LexogenSIRVData | exon | 2178 | 2406 | . | + | 0 | gene_id "SIRV5"; transcript_id "SIRV512"; exon_assignment "SIRV512_0"; |
| SIRV6 | LexogenSIRVData | exon | 1001 | 1186 | . | + | 0 | gene_id "SIRV6"; transcript_id "SIRV601"; exon_assignment "SIRV601_0"; |
| SIRV6 | LexogenSIRVData | exon | 1469 | 1534 | . | + | 0 | gene_id "SIRV6"; transcript_id "SIRV601"; exon_assignment "SIRV601_1"; |
| SIRV6 | LexogenSIRVData | exon | 1641 | 1735 | . | + | 0 | gene_id "SIRV6"; transcript_id "SIRV601"; exon_assignment "SIRV601_2"; |
| SIRV6 | LexogenSIRVData | exon | 2471 | 2620 | . | + | 0 | gene_id "SIRV6"; transcript_id "SIRV601"; exon_assignment "SIRV601_3"; |
| SIRV6 | LexogenSIRVData | exon | 2741 | 2828 | . | + | 0 | gene_id "SIRV6"; transcript_id "SIRV601"; exon_assignment "SIRV601_4"; |
| SIRV6 | LexogenSIRVData | exon | 3107 | 3164 | . | + | 0 | gene_id "SIRV6"; transcript_id "SIRV601"; exon_assignment "SIRV601_5"; |
| SIRV6 | LexogenSIRVData | exon | 10725 | 10818 | . | + | 0 | gene_id "SIRV6"; transcript_id "SIRV601"; exon_assignment "SIRV601_6"; |
| SIRV6 | LexogenSIRVData | exon | 11032 | 11108 | . | + | 0 | gene_id "SIRV6"; transcript_id "SIRV601"; exon_assignment "SIRV601_7"; |
| SIRV6 | LexogenSIRVData | exon | 11206 | 11826 | . | + | 0 | gene_id "SIRV6"; transcript_id "SIRV601"; exon_assignment "SIRV601_8"; |
| SIRV6 | LexogenSIRVData | exon | 1125 | 1186 | . | + | 0 | gene_id "SIRV6"; transcript_id "SIRV602"; exon_assignment "SIRV602_0"; |
| SIRV6 | LexogenSIRVData | exon | 1469 | 1534 | . | + | 0 | gene_id "SIRV6"; transcript_id "SIRV602"; exon_assignment "SIRV602_1"; |
| SIRV6 | LexogenSIRVData | exon | 1641 | 1735 | . | + | 0 | gene_id "SIRV6"; transcript_id "SIRV602"; exon_assignment "SIRV602_2"; |
| SIRV6 | LexogenSIRVData | exon | 2781 | 2828 | . | + | 0 | gene_id "SIRV6"; transcript_id "SIRV602"; exon_assignment "SIRV602_3"; |
| SIRV6 | LexogenSIRVData | exon | 3107 | 3164 | . | + | 0 | gene_id "SIRV6"; transcript_id "SIRV602"; exon_assignment "SIRV602_4"; |
| SIRV6 | LexogenSIRVData | exon | 10725 | 10818 | . | + | 0 | gene_id "SIRV6"; transcript_id "SIRV602"; exon_assignment "SIRV602_5"; |
| SIRV6 | LexogenSIRVData | exon | 11032 | 11108 | . | + | 0 | gene_id "SIRV6"; transcript_id "SIRV602"; exon_assignment "SIRV602_6"; |
| SIRV6 | LexogenSIRVData | exon | 11206 | 11279 | . | + | 0 | gene_id "SIRV6"; transcript_id "SIRV602"; exon_assignment "SIRV602_7"; |
| SIRV6 | LexogenSIRVData | exon | 9000 | 10968 | . | + | 0 | gene_id "SIRV6"; transcript_id "SIRV603"; exon_assignment "SIRV603_0"; |
| SIRV6 | LexogenSIRVData | exon | 1088 | 1186 | . | + | 0 | gene_id "SIRV6"; transcript_id "SIRV604"; exon_assignment "SIRV604_0"; |
| SIRV6 | LexogenSIRVData | exon | 1469 | 1534 | . | + | 0 | gene_id "SIRV6"; transcript_id "SIRV604"; exon_assignment "SIRV604_1"; |
| SIRV6 | LexogenSIRVData | exon | 1641 | 1735 | . | + | 0 | gene_id "SIRV6"; transcript_id "SIRV604"; exon_assignment "SIRV604_2"; |
| SIRV6 | LexogenSIRVData | exon | 1846 | 2026 | . | + | 0 | gene_id "SIRV6"; transcript_id "SIRV604"; exon_assignment "SIRV604_3"; |
| SIRV6 | LexogenSIRVData | exon | 2471 | 2620 | . | + | 0 | gene_id "SIRV6"; transcript_id "SIRV604"; exon_assignment "SIRV604_4"; |
| SIRV6 | LexogenSIRVData | exon | 2741 | 2828 | . | + | 0 | gene_id "SIRV6"; transcript_id "SIRV604"; exon_assignment "SIRV604_5"; |
| SIRV6 | LexogenSIRVData | exon | 3107 | 3164 | . | + | 0 | gene_id "SIRV6"; transcript_id "SIRV604"; exon_assignment "SIRV604_6"; |
| SIRV6 | LexogenSIRVData | exon | 10725 | 10818 | . | + | 0 | gene_id "SIRV6"; transcript_id "SIRV604"; exon_assignment "SIRV604_7"; |

APPENDIX B-continued

| | | GTF file SIRV C | | | | | | |
|---|---|---|---|---|---|---|---|---|
| SIRV6 | LexogenSIRVData | exon | 11035 | 11108 | . | + | 0 | gene_id "SIRV6"; transcript_id "SIRV604"; exon_assignment "SIRV604_8"; |
| SIRV6 | LexogenSIRVData | exon | 11206 | 11837 | . | + | 0 | gene_id "SIRV6"; transcript_id "SIRV604"; exon_assignment "SIRV604_9"; |
| SIRV6 | LexogenSIRVData | exon | 1131 | 1186 | . | + | 0 | gene_id "SIRV6"; transcript_id "SIRV605"; exon_assignment "SIRV605_0"; |
| SIRV6 | LexogenSIRVData | exon | 1469 | 1534 | . | + | 0 | gene_id "SIRV6"; transcript_id "SIRV605"; exon_assignment "SIRV605_1"; |
| SIRV6 | LexogenSIRVData | exon | 1641 | 1735 | . | + | 0 | gene_id "SIRV6"; transcript_id "SIRV605"; exon_assignment "SIRV605_2"; |
| SIRV6 | LexogenSIRVData | exon | 1846 | 2026 | . | + | 0 | gene_id "SIRV6"; transcript_id "SIRV605"; exon_assignment "SIRV605_3"; |
| SIRV6 | LexogenSIRVData | exon | 2471 | 2620 | . | + | 0 | gene_id "SIRV6"; transcript_id "SIRV605"; exon_assignment "SIRV605_4"; |
| SIRV6 | LexogenSIRVData | exon | 2741 | 2828 | . | + | 0 | gene_id "SIRV6"; transcript_id "SIRV605"; exon_assignment "SIRV605_5"; |
| SIRV6 | LexogenSIRVData | exon | 3107 | 3164 | . | + | 0 | gene_id "SIRV6"; transcript_id "SIRV605"; exon_assignment "SIRV605_6"; |
| SIRV6 | LexogenSIRVData | exon | 10725 | 10818 | . | + | 0 | gene_id "SIRV6"; transcript_id "SIRV605"; exon_assignment "SIRV605_7"; |
| SIRV6 | LexogenSIRVData | exon | 11032 | 11331 | . | + | 0 | gene_id "SIRV6"; transcript_id "SIRV605"; exon_assignment "SIRV605_8"; |
| SIRV6 | LexogenSIRVData | exon | 2286 | 2620 | . | + | 0 | gene_id "SIRV6"; transcript_id "SIRV606"; exon_assignment "SIRV606_0"; |
| SIRV6 | LexogenSIRVData | exon | 2741 | 2828 | . | + | 0 | gene_id "SIRV6"; transcript_id "SIRV606"; exon_assignment "SIRV606_1"; |
| SIRV6 | LexogenSIRVData | exon | 3107 | 3164 | . | + | 0 | gene_id "SIRV6"; transcript_id "SIRV606"; exon_assignment "SIRV606_2"; |
| SIRV6 | LexogenSIRVData | exon | 10725 | 10788 | . | + | 0 | gene_id "SIRV6"; transcript_id "SIRV606"; exon_assignment "SIRV606_3"; |
| SIRV6 | LexogenSIRVData | exon | 1131 | 1186 | . | + | 0 | gene_id "SIRV6"; transcript_id "SIRV607"; exon_assignment "SIRV607_0"; |
| SIRV6 | LexogenSIRVData | exon | 1469 | 1735 | . | + | 0 | gene_id "SIRV6"; transcript_id "SIRV607"; exon_assignment "SIRV607_1"; |
| SIRV6 | LexogenSIRVData | exon | 1846 | 2026 | . | + | 0 | gene_id "SIRV6"; transcript_id "SIRV607"; exon_assignment "SIRV607_2"; |
| SIRV6 | LexogenSIRVData | exon | 2471 | 2540 | . | + | 0 | gene_id "SIRV6"; transcript_id "SIRV607"; exon_assignment "SIRV607_3"; |
| SIRV6 | LexogenSIRVData | exon | 3024 | 3164 | . | + | 0 | gene_id "SIRV6"; transcript_id "SIRV608"; exon_assignment "SIRV608_0"; |
| SIRV6 | LexogenSIRVData | exon | 10725 | 10818 | . | + | 0 | gene_id "SIRV6"; transcript_id "SIRV608"; exon_assignment "SIRV608_1"; |
| SIRV6 | LexogenSIRVData | exon | 11032 | 11108 | . | + | 0 | gene_id "SIRV6"; transcript_id "SIRV608"; exon_assignment "SIRV608_2"; |
| SIRV6 | LexogenSIRVData | exon | 11206 | 11270 | . | + | 0 | gene_id "SIRV6"; transcript_id "SIRV608"; exon_assignment "SIRV608_3"; |
| SIRV6 | LexogenSIRVData | exon | 1138 | 1186 | . | + | 0 | gene_id "SIRV6"; transcript_id "SIRV609"; exon_assignment "SIRV609_0"; |
| SIRV6 | LexogenSIRVData | exon | 1469 | 1534 | . | + | 0 | gene_id "SIRV6"; transcript_id "SIRV609"; exon_assignment "SIRV609_1"; |
| SIRV6 | LexogenSIRVData | exon | 1641 | 1735 | . | + | 0 | gene_id "SIRV6"; transcript_id "SIRV609"; exon_assignment "SIRV609_2"; |
| SIRV6 | LexogenSIRVData | exon | 1846 | 2120 | . | + | 0 | gene_id "SIRV6"; transcript_id "SIRV609"; exon_assignment "SIRV609_3"; |
| SIRV6 | LexogenSIRVData | exon | 2473 | 2620 | . | + | 0 | gene_id "SIRV6"; transcript_id "SIRV610"; exon_assignment "SIRV610_0"; |
| SIRV6 | LexogenSIRVData | exon | 2741 | 2828 | . | + | 0 | gene_id "SIRV6"; transcript_id "SIRV610"; exon_assignment "SIRV610_1"; |
| SIRV6 | LexogenSIRVData | exon | 3107 | 3164 | . | + | 0 | gene_id "SIRV6"; transcript_id "SIRV610"; exon_assignment "SIRV610_2"; |
| SIRV6 | LexogenSIRVData | exon | 10725 | 11108 | . | + | 0 | gene_id "SIRV6"; transcript_id "SIRV610"; exon_assignment "SIRV610_3"; |
| SIRV6 | LexogenSIRVData | exon | 11206 | 11690 | . | + | 0 | gene_id "SIRV6"; transcript_id "SIRV610"; exon_assignment "SIRV610_4"; |
| SIRV6 | LexogenSIRVData | exon | 1304 | 1381 | . | + | 0 | gene_id "SIRV6"; transcript_id "SIRV611"; exon_assignment "SIRV611_0"; |
| SIRV6 | LexogenSIRVData | exon | 1469 | 1534 | . | + | 0 | gene_id "SIRV6"; transcript_id "SIRV611"; exon_assignment "SIRV611_1"; |
| SIRV6 | LexogenSIRVData | exon | 1641 | 1950 | . | + | 0 | gene_id "SIRV6"; transcript_id "SIRV611"; exon_assignment "SIRV611_2"; |
| SIRV6 | LexogenSIRVData | exon | 1088 | 1186 | . | + | 0 | gene_id "SIRV6"; transcript_id "SIRV612"; exon_assignment "SIRV612_0"; |
| SIRV6 | LexogenSIRVData | exon | 1469 | 1534 | . | + | 0 | gene_id "SIRV6"; transcript_id "SIRV612"; exon_assignment "SIRV612_1"; |
| SIRV6 | LexogenSIRVData | exon | 1641 | 1735 | . | + | 0 | gene_id "SIRV6"; transcript_id "SIRV612"; exon_assignment "SIRV612_2"; |
| SIRV6 | LexogenSIRVData | exon | 1846 | 2026 | . | + | 0 | gene_id "SIRV6"; transcript_id "SIRV612"; exon_assignment "SIRV612_3"; |
| SIRV6 | LexogenSIRVData | exon | 2471 | 2620 | . | + | 0 | gene_id "SIRV6"; transcript_id "SIRV612"; exon_assignment "SIRV612_4"; |
| SIRV6 | LexogenSIRVData | exon | 2741 | 2828 | . | + | 0 | gene_id "SIRV6"; transcript_id "SIRV612"; exon_assignment "SIRV612_5"; |
| SIRV6 | LexogenSIRVData | exon | 3107 | 3164 | . | + | 0 | gene_id "SIRV6"; transcript_id "SIRV612"; exon_assignment "SIRV612_6"; |
| SIRV6 | LexogenSIRVData | exon | 10725 | 10818 | . | + | 0 | gene_id "SIRV6"; transcript_id "SIRV612"; exon_assignment "SIRV612_7"; |
| SIRV6 | LexogenSIRVData | exon | 11032 | 11108 | . | + | 0 | gene_id "SIRV6"; transcript_id "SIRV612"; exon_assignment "SIRV612_8"; |
| SIRV6 | LexogenSIRVData | exon | 11206 | 11825 | . | + | 0 | gene_id "SIRV6"; transcript_id "SIRV612"; exon_assignment "SIRV612_9"; |
| SIRV6 | LexogenSIRVData | exon | 3106 | 3164 | . | + | 0 | gene_id "SIRV6"; transcript_id "SIRV613"; exon_assignment "SIRV613_0"; |
| SIRV6 | LexogenSIRVData | exon | 7105 | 7448 | . | + | 0 | gene_id "SIRV6"; transcript_id "SIRV613"; exon_assignment "SIRV613_1"; |
| SIRV6 | LexogenSIRVData | exon | 7806 | 7923 | . | + | 0 | gene_id "SIRV6"; transcript_id "SIRV613"; exon_assignment "SIRV613_2"; |
| SIRV6 | LexogenSIRVData | exon | 10725 | 10818 | . | + | 0 | gene_id "SIRV6"; transcript_id "SIRV613"; exon_assignment "SIRV613_3"; |
| SIRV6 | LexogenSIRVData | exon | 11032 | 11108 | . | + | 0 | gene_id "SIRV6"; transcript_id "SIRV613"; exon_assignment "SIRV613_4"; |
| SIRV6 | LexogenSIRVData | exon | 11206 | 11824 | . | + | 0 | gene_id "SIRV6"; transcript_id "SIRV613"; exon_assignment "SIRV613_5"; |
| SIRV6 | LexogenSIRVData | exon | 2517 | 2620 | . | + | 0 | gene_id "SIRV6"; transcript_id "SIRV614"; exon_assignment "SIRV614_0"; |
| SIRV6 | LexogenSIRVData | exon | 2741 | 2828 | . | + | 0 | gene_id "SIRV6"; transcript_id "SIRV614"; exon_assignment "SIRV614_1"; |
| SIRV6 | LexogenSIRVData | exon | 3107 | 3164 | . | + | 0 | gene_id "SIRV6"; transcript_id "SIRV614"; exon_assignment "SIRV614_2"; |
| SIRV6 | LexogenSIRVData | exon | 7806 | 7923 | . | + | 0 | gene_id "SIRV6"; transcript_id "SIRV614"; exon_assignment "SIRV614_3"; |
| SIRV6 | LexogenSIRVData | exon | 10725 | 10815 | . | + | 0 | gene_id "SIRV6"; transcript_id "SIRV614"; exon_assignment "SIRV614_4"; |
| SIRV6 | LexogenSIRVData | exon | 10238 | 10818 | . | + | 0 | gene_id "SIRV6"; transcript_id "SIRV615"; exon_assignment "SIRV615_0"; |
| SIRV6 | LexogenSIRVData | exon | 11032 | 11108 | . | + | 0 | gene_id "SIRV6"; transcript_id "SIRV615"; exon_assignment "SIRV615_1"; |
| SIRV6 | LexogenSIRVData | exon | 11206 | 11330 | . | + | 0 | gene_id "SIRV6"; transcript_id "SIRV615"; exon_assignment "SIRV615_2"; |
| SIRV6 | LexogenSIRVData | exon | 2286 | 2620 | . | + | 0 | gene_id "SIRV6"; transcript_id "SIRV616"; exon_assignment "SIRV616_0"; |
| SIRV6 | LexogenSIRVData | exon | 2741 | 2814 | . | + | 0 | gene_id "SIRV6"; transcript_id "SIRV616"; exon_assignment "SIRV616_1"; |
| SIRV6 | LexogenSIRVData | exon | 3107 | 3164 | . | + | 0 | gene_id "SIRV6"; transcript_id "SIRV616"; exon_assignment "SIRV616_2"; |
| SIRV6 | LexogenSIRVData | exon | 10725 | 10788 | . | + | 0 | gene_id "SIRV6"; transcript_id "SIRV616"; exon_assignment "SIRV616_3"; |
| SIRV6 | LexogenSIRVData | exon | 1545 | 1820 | . | − | 0 | gene_id "SIRV6"; transcript_id "SIRV617"; exon_assignment "SIRV617_0"; |
| SIRV6 | LexogenSIRVData | exon | 2359 | 2547 | . | − | 0 | gene_id "SIRV6"; transcript_id "SIRV618"; exon_assignment "SIRV618_0"; |
| SIRV7 | LexogenSIRVData | exon | 1004 | 2675 | . | − | 0 | gene_id "SIRV7"; transcript_id "SIRV701"; exon_assignment "SIRV701_0"; |
| SIRV7 | LexogenSIRVData | exon | 2994 | 3111 | . | − | 0 | gene_id "SIRV7"; transcript_id "SIRV701"; exon_assignment "SIRV701_1"; |
| SIRV7 | LexogenSIRVData | exon | 43029 | 43077 | . | − | 0 | gene_id "SIRV7"; transcript_id "SIRV701"; exon_assignment "SIRV701_2"; |
| SIRV7 | LexogenSIRVData | exon | 114681 | 114988 | . | − | 0 | gene_id "SIRV7"; transcript_id "SIRV701"; exon_assignment "SIRV701_3"; |
| SIRV7 | LexogenSIRVData | exon | 147609 | 147923 | . | − | 0 | gene_id "SIRV7"; transcript_id "SIRV701"; exon_assignment "SIRV701_4"; |
| SIRV7 | LexogenSIRVData | exon | 1001 | 2675 | . | − | 0 | gene_id "SIRV7"; transcript_id "SIRV702"; exon_assignment "SIRV702_0"; |
| SIRV7 | LexogenSIRVData | exon | 2994 | 3111 | . | − | 0 | gene_id "SIRV7"; transcript_id "SIRV702"; exon_assignment "SIRV702_1"; |
| SIRV7 | LexogenSIRVData | exon | 4096 | 4179 | . | − | 0 | gene_id "SIRV7"; transcript_id "SIRV702"; exon_assignment "SIRV702_2"; |
| SIRV7 | LexogenSIRVData | exon | 4726 | 4810 | . | − | 0 | gene_id "SIRV7"; transcript_id "SIRV702"; exon_assignment "SIRV702_3"; |
| SIRV7 | LexogenSIRVData | exon | 43029 | 43077 | . | − | 0 | gene_id "SIRV7"; transcript_id "SIRV702"; exon_assignment "SIRV702_4"; |
| SIRV7 | LexogenSIRVData | exon | 114681 | 114916 | . | − | 0 | gene_id "SIRV7"; transcript_id "SIRV702"; exon_assignment "SIRV702_5"; |
| SIRV7 | LexogenSIRVData | exon | 1001 | 2675 | . | − | 0 | gene_id "SIRV7"; transcript_id "SIRV703"; exon_assignment "SIRV703_0"; |
| SIRV7 | LexogenSIRVData | exon | 2994 | 3111 | . | − | 0 | gene_id "SIRV7"; transcript_id "SIRV703"; exon_assignment "SIRV703_1"; |

APPENDIX B-continued

GTF file SIRV C

| | | | | | | | | |
|---|---|---|---|---|---|---|---|---|
| SIRV7 | LexogenSIRVData | exon | 3810 | 3896 | . | – | 0 | gene_id "SIRV7"; transcript_id "SIRV703"; exon_assignment "SIRV703_2"; |
| SIRV7 | LexogenSIRVData | exon | 114681 | 114988 | . | – | 0 | gene_id "SIRV7"; transcript_id "SIRV703"; exon_assignment "SIRV703_3"; |
| SIRV7 | LexogenSIRVData | exon | 147609 | 147918 | . | – | 0 | gene_id "SIRV7"; transcript_id "SIRV703"; exon_assignment "SIRV703_4"; |
| SIRV7 | LexogenSIRVData | exon | 55850 | 56097 | . | – | 0 | gene_id "SIRV7"; transcript_id "SIRV704"; exon_assignment "SIRV704_0; |
| SIRV7 | LexogenSIRVData | exon | 78842 | 78963 | . | – | 0 | gene_id "SIRV7"; transcript_id "SIRV704"; exon_assignment "SIRV704_1"; |
| SIRV7 | LexogenSIRVData | exon | 114681 | 114738 | . | – | 0 | gene_id "SIRV7"; transcript_id "SIRV704"; exon_assignment "SIRV704_2; |
| SIRV7 | LexogenSIRVData | exon | 1006 | 2675 | . | – | 0 | gene_id "SIRV7"; transcript_id "SIRV705"; exon_assignment "SIRV705_0"; |
| SIRV7 | LexogenSIRVData | exon | 2994 | 3111 | . | – | 0 | gene_id "SIRV7"; transcript_id "SIRV705"; exon_assignment "SIRV705_1; |
| SIRV7 | LexogenSIRVData | exon | 43029 | 43077 | . | – | 0 | gene_id "SIRV7"; transcript_id "SIRV705"; exon_assignment "SIRV705_2"; |
| SIRV7 | LexogenSIRVData | exon | 114681 | 114988 | . | – | 0 | gene_id "SIRV7"; transcript_id "SIRV705"; exon_assignment "SIRV705_3; |
| SIRV7 | LexogenSIRVData | exon | 147609 | 147925 | . | – | 0 | gene_id "SIRV7"; transcript_id "SIRV705"; exon_assignment "SIRV705_4"; |
| SIRV7 | LexogenSIRVData | exon | 56032 | 56097 | . | – | 0 | gene_id "SIRV7"; transcript_id "SIRV706"; exon_assignment "SIRV706_0; |
| SIRV7 | LexogenSIRVData | exon | 70884 | 70987 | . | – | 0 | gene_id "SIRV7"; transcript_id "SIRV706"; exon_assignment "SIRV706_1"; |
| SIRV7 | LexogenSIRVData | exon | 78842 | 78963 | . | – | 0 | gene_id "SIRV7"; transcript_id "SIRV706"; exon_assignment "SIRV706_2"; |
| SIRV7 | LexogenSIRVData | exon | 114681 | 114988 | . | – | 0 | gene_id "SIRV7"; transcript_id "SIRV706"; exon_assignment "SIRV706_3"; |
| SIRV7 | LexogenSIRVData | exon | 147609 | 147957 | . | – | 0 | gene_id "SIRV7"; transcript_id "SIRV706"; exon_assignment "SIRV706_4"; |
| SIRV7 | LexogenSIRVData | exon | 56038 | 56097 | . | – | 0 | gene_id "SIRV7"; transcript_id "SIRV708"; exon_assignment "SIRV708_0"; |
| SIRV7 | LexogenSIRVData | exon | 70884 | 70987 | . | – | 0 | gene_id "SIRV7"; transcript_id "SIRV708"; exon_assignment "SIRV708_1"; |
| SIRV7 | LexogenSIRVData | exon | 78842 | 78908 | . | – | 0 | gene_id "SIRV7"; transcript_id "SIRV708"; exon_assignment "SIRV708_2"; |
| SIRV7 | LexogenSIRVData | exon | 78929 | 78963 | . | – | 0 | gene_id "SIRV7"; transcript_id "SIRV708"; exon_assignment "SIRV708_3"; |
| SIRV7 | LexogenSIRVData | exon | 114687 | 114960 | . | – | 0 | gene_id "SIRV7"; transcript_id "SIRV708"; exon_assignment "SIRV708_4"; |
| SIRV7 | LexogenSIRVData | exon | 147609 | 147957 | . | – | 0 | gene_id "SIRV7"; transcript_id "SIRV708"; exon_assignment "SIRV708_5"; |

APPENDIX C

GTF file SIRV O

| | | | | | | | | |
|---|---|---|---|---|---|---|---|---|
| SIRV1 | LexogenSIRVData | exon | 1001 | 1484 | . | – | 0 | gene_id "SIRV1"; transcript_id "SIRV101"; exon_assignment "SIRV101_0"; |
| SIRV1 | LexogenSIRVData | exon | 6338 | 6473 | . | – | 0 | gene_id "SIRV1"; transcript_id "SIRV101"; exon_assignment "SIRV101_1"; |
| SIRV1 | LexogenSIRVData | exon | 6561 | 6813 | . | – | 0 | gene_id "SIRV1"; transcript_id "SIRV101"; exon_assignment "SIRV101_2"; |
| SIRV1 | LexogenSIRVData | exon | 7553 | 7814 | . | – | 0 | gene_id "SIRV1"; transcript_id "SIRV101"; exon_assignment "SIRV101_3"; |
| SIRV1 | LexogenSIRVData | exon | 10283 | 10366 | . | – | 0 | gene_id "SIRV1"; transcript_id "SIRV101"; exon_assignment "SIRV101_4"; |
| SIRV1 | LexogenSIRVData | exon | 10445 | 10786 | . | – | 0 | gene_id "SIRV1"; transcript_id "SIRV101"; exon_assignment "SIRV101_5"; |
| SIRV1 | LexogenSIRVData | exon | 1007 | 1484 | . | – | 0 | gene_id "SIRV1"; transcript_id "SIRV102"; exon_assignment "SIRV102_0"; |
| SIRV1 | LexogenSIRVData | exon | 6338 | 6813 | . | – | 0 | gene_id "SIRV1"; transcript_id "SIRV102"; exon_assignment "SIRV102_1"; |
| SIRV1 | LexogenSIRVData | exon | 7553 | 7814 | . | – | 0 | gene_id "SIRV1"; transcript_id "SIRV102"; exon_assignment "SIRV102_2"; |
| SIRV1 | LexogenSIRVData | exon | 10283 | 10366 | . | – | 0 | gene_id "SIRV1"; transcript_id "SIRV102"; exon_assignment "SIRV102_3"; |
| SIRV1 | LexogenSIRVData | exon | 1001 | 1484 | . | – | 0 | gene_id "SIRV1"; transcript_id "SIRV103"; exon_assignment "SIRV103_0"; |
| SIRV1 | LexogenSIRVData | exon | 6338 | 6473 | . | – | 0 | gene_id "SIRV1"; transcript_id "SIRV103"; exon_assignment "SIRV103_1"; |
| SIRV1 | LexogenSIRVData | exon | 6561 | 6813 | . | – | 0 | gene_id "SIRV1"; transcript_id "SIRV103"; exon_assignment "SIRV103_2"; |
| SIRV1 | LexogenSIRVData | exon | 7553 | 7814 | . | – | 0 | gene_id "SIRV1"; transcript_id "SIRV103"; exon_assignment "SIRV103_3"; |
| SIRV1 | LexogenSIRVData | exon | 10283 | 10366 | . | – | 0 | gene_id "SIRV1"; transcript_id "SIRV103"; exon_assignment "SIRV103_4"; |
| SIRV1 | LexogenSIRVData | exon | 10648 | 10791 | . | – | 0 | gene_id "SIRV1"; transcript_id "SIRV103"; exon_assignment "SIRV103_5"; |
| SIRV1 | LexogenSIRVData | exon | 6450 | 6473 | . | – | 0 | gene_id "SIRV1"; transcript_id "SIRV105"; exon_assignment "SIRV105_0"; |
| SIRV1 | LexogenSIRVData | exon | 6561 | 6813 | . | – | 0 | gene_id "SIRV1"; transcript_id "SIRV105"; exon_assignment "SIRV105_1"; |
| SIRV1 | LexogenSIRVData | exon | 7553 | 7814 | . | – | 0 | gene_id "SIRV1"; transcript_id "SIRV105"; exon_assignment "SIRV105_2"; |
| SIRV1 | LexogenSIRVData | exon | 10283 | 10366 | . | – | 0 | gene_id "SIRV1"; transcript_id "SIRV105"; exon_assignment "SIRV105_3"; |
| SIRV1 | LexogenSIRVData | exon | 10594 | 10640 | . | – | 0 | gene_id "SIRV1"; transcript_id "SIRV105"; exon_assignment "SIRV105_4"; |
| SIRV1 | LexogenSIRVData | exon | 1001 | 1484 | . | – | 0 | gene_id "SIRV1"; transcript_id "SIRV106"; exon_assignment "SIRV106_0"; |
| SIRV1 | LexogenSIRVData | exon | 7553 | 7808 | . | – | 0 | gene_id "SIRV1"; transcript_id "SIRV106"; exon_assignment "SIRV106_1"; |
| SIRV1 | LexogenSIRVData | exon | 10554 | 10786 | . | – | 0 | gene_id "SIRV1"; transcript_id "SIRV106"; exon_assignment "SIRV106_2"; |
| SIRV1 | LexogenSIRVData | exon | 10648 | 10791 | . | – | 0 | gene_id "SIRV1"; transcript_id "SIRV107"; exon_assignment "SIRV107_0"; |
| SIRV1 | LexogenSIRVData | exon | 10883 | 11242 | . | – | 0 | gene_id "SIRV1"; transcript_id "SIRV107"; exon_assignment "SIRV107_1"; |
| SIRV1 | LexogenSIRVData | exon | 11404 | 11643 | . | – | 0 | gene_id "SIRV1"; transcript_id "SIRV107"; exon_assignment "SIRV107_2"; |
| SIRV1 | LexogenSIRVData | exon | 10583 | 10791 | . | + | 0 | gene_id "SIRV1"; transcript_id "SIRV108"; exon_assignment "SIRV108_0"; |
| SIRV1 | LexogenSIRVData | exon | 10898 | 11187 | . | + | 0 | gene_id "SIRV1"; transcript_id "SIRV108"; exon_assignment "SIRV108_1"; |
| SIRV1 | LexogenSIRVData | exon | 11404 | 11606 | . | + | 0 | gene_id "SIRV1"; transcript_id "SIRV108"; exon_assignment "SIRV108_2"; |
| SIRV1 | LexogenSIRVData | exon | 10712 | 10791 | . | + | 0 | gene_id "SIRV1"; transcript_id "SIRV109"; exon_assignment "SIRV109_0"; |
| SIRV1 | LexogenSIRVData | exon | 10883 | 11057 | . | + | 0 | gene_id "SIRV1"; transcript_id "SIRV109"; exon_assignment "SIRV109_1"; |
| SIRV1 | LexogenSIRVData | exon | 11435 | 11643 | . | + | 0 | gene_id "SIRV1"; transcript_id "SIRV109"; exon_assignment "SIRV109_2"; |
| SIRV1 | LexogenSIRVData | exon | 1001 | 1484 | . | – | 0 | gene_id "SIRV1"; transcript_id "SIRV104"; exon_assignment "SIRV104_0"; |
| SIRV1 | LexogenSIRVData | exon | 6338 | 6473 | . | – | 0 | gene_id "SIRV1"; transcript_id "SIRV104"; exon_assignment "SIRV104_1"; |
| SIRV1 | LexogenSIRVData | exon | 6561 | 6813 | . | – | 0 | gene_id "SIRV1"; transcript_id "SIRV104"; exon_assignment "SIRV104_2"; |
| SIRV1 | LexogenSIRVData | exon | 7553 | 7814 | . | – | 0 | gene_id "SIRV1"; transcript_id "SIRV104"; exon_assignment "SIRV104_3"; |
| SIRV1 | LexogenSIRVData | exon | 10283 | 10366 | . | – | 0 | gene_id "SIRV1"; transcript_id "SIRV104"; exon_assignment "SIRV104_4"; |
| SIRV1 | LexogenSIRVData | exon | 10445 | 10508 | . | – | 0 | gene_id "SIRV1"; transcript_id "SIRV104"; exon_assignment "SIRV104_5"; |
| SIRV1 | LexogenSIRVData | exon | 10648 | 10763 | . | – | 0 | gene_id "SIRV1"; transcript_id "SIRV104"; exon_assignment "SIRV104_6"; |
| SIRV1 | LexogenSIRVData | exon | 10720 | 10791 | . | + | 0 | gene_id "SIRV1"; transcript_id "SIRV110"; exon_assignment "SIRV110_0"; |
| SIRV1 | LexogenSIRVData | exon | 10883 | 10995 | . | + | 0 | gene_id "SIRV1"; transcript_id "SIRV110"; exon_assignment "SIRV110_1"; |
| SIRV1 | LexogenSIRVData | exon | 11435 | 11643 | . | + | 0 | gene_id "SIRV1"; transcript_id "SIRV110"; exon_assignment "SIRV110_2"; |
| SIRV1 | LexogenSIRVData | exon | 6450 | 6473 | . | – | 0 | gene_id "SIRV1"; transcript_id "SIRV111"; exon_assignment "SIRV111_0"; |
| SIRV1 | LexogenSIRVData | exon | 6561 | 6813 | . | – | 0 | gene_id "SIRV1"; transcript_id "SIRV111"; exon_assignment "SIRV111_1"; |
| SIRV1 | LexogenSIRVData | exon | 7553 | 7808 | . | – | 0 | gene_id "SIRV1"; transcript_id "SIRV111"; exon_assignment "SIRV111_2"; |
| SIRV1 | LexogenSIRVData | exon | 10648 | 10791 | . | – | 0 | gene_id "SIRV1"; transcript_id "SIRV111"; exon_assignment "SIRV111_3"; |
| SIRV1 | LexogenSIRVData | exon | 10883 | 11242 | . | – | 0 | gene_id "SIRV1"; transcript_id "SIRV111"; exon_assignment "SIRV111_4"; |

APPENDIX C-continued

GTF file SIRV O

| | | | | | | | | |
|---|---|---|---|---|---|---|---|---|
| SIRV1 | LexogenSIRVData | exon | 11404 | 11643 | . | − | 0 | gene_id "SIRV1"; transcript_id "SIRV111"; exon_assignment "SIRV111_5"; |
| SIRV1 | LexogenSIRVData | exon | 1007 | 1484 | . | − | 0 | gene_id "SIRV1"; transcript_id "SIRV112"; exon_assignment "SIRV112_0"; |
| SIRV1 | LexogenSIRVData | exon | 6561 | 6813 | . | − | 0 | gene_id "SIRV1"; transcript_id "SIRV112"; exon_assignment "SIRV112_1"; |
| SIRV1 | LexogenSIRVData | exon | 7553 | 7814 | . | − | 0 | gene_id "SIRV1"; transcript_id "SIRV112"; exon_assignment "SIRV112_2"; |
| SIRV1 | LexogenSIRVData | exon | 10283 | 10366 | . | − | 0 | gene_id "SIRV1"; transcript_id "SIRV112"; exon_assignment "SIRV112_3"; |
| SIRV1 | LexogenSIRVData | exon | 10445 | 10791 | . | − | 0 | gene_id "SIRV1"; transcript_id "SIRV112"; exon_assignment "SIRV112_4"; |
| SIRV2 | LexogenSIRVData | exon | 1001 | 1661 | . | − | 0 | gene_id "SIRV2"; transcript_id "SIRV201"; exon_assignment "SIRV201_0"; |
| SIRV2 | LexogenSIRVData | exon | 1742 | 1853 | . | − | 0 | gene_id "SIRV2"; transcript_id "SIRV201"; exon_assignment "SIRV201_1"; |
| SIRV2 | LexogenSIRVData | exon | 1974 | 2064 | . | − | 0 | gene_id "SIRV2"; transcript_id "SIRV201"; exon_assignment "SIRV201_2"; |
| SIRV2 | LexogenSIRVData | exon | 2675 | 2802 | . | − | 0 | gene_id "SIRV2"; transcript_id "SIRV201"; exon_assignment "SIRV201_3"; |
| SIRV2 | LexogenSIRVData | exon | 2882 | 3010 | . | − | 0 | gene_id "SIRV2"; transcript_id "SIRV201"; exon_assignment "SIRV201_4"; |
| SIRV2 | LexogenSIRVData | exon | 3106 | 3374 | . | − | 0 | gene_id "SIRV2"; transcript_id "SIRV201"; exon_assignment "SIRV201_5"; |
| SIRV2 | LexogenSIRVData | exon | 3666 | 3825 | . | − | 0 | gene_id "SIRV2"; transcript_id "SIRV201"; exon_assignment "SIRV201_6"; |
| SIRV2 | LexogenSIRVData | exon | 3967 | 4094 | . | − | 0 | gene_id "SIRV2"; transcript_id "SIRV201"; exon_assignment "SIRV201_7"; |
| SIRV2 | LexogenSIRVData | exon | 4339 | 4479 | . | − | 0 | gene_id "SIRV2"; transcript_id "SIRV201"; exon_assignment "SIRV201_8"; |
| SIRV2 | LexogenSIRVData | exon | 4688 | 4800 | . | − | 0 | gene_id "SIRV2"; transcript_id "SIRV201"; exon_assignment "SIRV201_9"; |
| SIRV2 | LexogenSIRVData | exon | 5789 | 5907 | . | − | 0 | gene_id "SIRV2"; transcript_id "SIRV201"; exon_assignment "SIRV201_10"; |
| SIRV2 | LexogenSIRVData | exon | 1036 | 1661 | . | − | 0 | gene_id "SIRV2"; transcript_id "SIRV202"; exon_assignment "SIRV202_0"; |
| SIRV2 | LexogenSIRVData | exon | 1742 | 1853 | . | − | 0 | gene_id "SIRV2"; transcript_id "SIRV202"; exon_assignment "SIRV202_1"; |
| SIRV2 | LexogenSIRVData | exon | 1974 | 2064 | . | − | 0 | gene_id "SIRV2"; transcript_id "SIRV202"; exon_assignment "SIRV202_2"; |
| SIRV2 | LexogenSIRVData | exon | 2675 | 2802 | . | − | 0 | gene_id "SIRV2"; transcript_id "SIRV202"; exon_assignment "SIRV202_3"; |
| SIRV2 | LexogenSIRVData | exon | 2882 | 3010 | . | − | 0 | gene_id "SIRV2"; transcript_id "SIRV202"; exon_assignment "SIRV202_4"; |
| SIRV2 | LexogenSIRVData | exon | 3106 | 3325 | . | − | 0 | gene_id "SIRV2"; transcript_id "SIRV202"; exon_assignment "SIRV202_5"; |
| SIRV2 | LexogenSIRVData | exon | 3666 | 3825 | . | − | 0 | gene_id "SIRV2"; transcript_id "SIRV202"; exon_assignment "SIRV202_6"; |
| SIRV2 | LexogenSIRVData | exon | 3967 | 4094 | . | − | 0 | gene_id "SIRV2"; transcript_id "SIRV202"; exon_assignment "SIRV202_7"; |
| SIRV2 | LexogenSIRVData | exon | 4339 | 4479 | . | − | 0 | gene_id "SIRV2"; transcript_id "SIRV202"; exon_assignment "SIRV202_8"; |
| SIRV2 | LexogenSIRVData | exon | 4688 | 4800 | . | − | 0 | gene_id "SIRV2"; transcript_id "SIRV202"; exon_assignment "SIRV202_9"; |
| SIRV2 | LexogenSIRVData | exon | 5789 | 5911 | . | − | 0 | gene_id "SIRV2"; transcript_id "SIRV202"; exon_assignment "SIRV202_10"; |
| SIRV2 | LexogenSIRVData | exon | 3666 | 3825 | . | − | 0 | gene_id "SIRV2"; transcript_id "SIRV203"; exon_assignment "SIRV203_0"; |
| SIRV2 | LexogenSIRVData | exon | 3967 | 4094 | . | − | 0 | gene_id "SIRV2"; transcript_id "SIRV203"; exon_assignment "SIRV203_1"; |
| SIRV2 | LexogenSIRVData | exon | 4339 | 4479 | . | − | 0 | gene_id "SIRV2"; transcript_id "SIRV203"; exon_assignment "SIRV203_2"; |
| SIRV2 | LexogenSIRVData | exon | 4688 | 4800 | . | − | 0 | gene_id "SIRV2"; transcript_id "SIRV203"; exon_assignment "SIRV203_3"; |
| SIRV2 | LexogenSIRVData | exon | 5752 | 5895 | . | − | 0 | gene_id "SIRV2"; transcript_id "SIRV203"; exon_assignment "SIRV203_4"; |
| SIRV2 | LexogenSIRVData | exon | 3644 | 3825 | . | − | 0 | gene_id "SIRV2"; transcript_id "SIRV204"; exon_assignment "SIRV204_0"; |
| SIRV2 | LexogenSIRVData | exon | 3967 | 4479 | . | − | 0 | gene_id "SIRV2"; transcript_id "SIRV204"; exon_assignment "SIRV204_1"; |
| SIRV2 | LexogenSIRVData | exon | 4688 | 4732 | . | − | 0 | gene_id "SIRV2"; transcript_id "SIRV204"; exon_assignment "SIRV204_2"; |
| SIRV2 | LexogenSIRVData | exon | 1109 | 1631 | . | + | 0 | gene_id "SIRV2"; transcript_id "SIRV205"; exon_assignment "SIRV205_0"; |
| SIRV2 | LexogenSIRVData | exon | 4034 | 4457 | . | + | 0 | gene_id "SIRV2"; transcript_id "SIRV206"; exon_assignment "SIRV206_0"; |
| SIRV2 | LexogenSIRVData | exon | 1001 | 1661 | . | − | 0 | gene_id "SIRV2"; transcript_id "SIRV207"; exon_assignment "SIRV207_0"; |
| SIRV2 | LexogenSIRVData | exon | 1742 | 1853 | . | − | 0 | gene_id "SIRV2"; transcript_id "SIRV207"; exon_assignment "SIRV207_1"; |
| SIRV2 | LexogenSIRVData | exon | 1974 | 2064 | . | − | 0 | gene_id "SIRV2"; transcript_id "SIRV207"; exon_assignment "SIRV207_2"; |
| SIRV2 | LexogenSIRVData | exon | 2675 | 2802 | . | − | 0 | gene_id "SIRV2"; transcript_id "SIRV207"; exon_assignment "SIRV207_3"; |
| SIRV2 | LexogenSIRVData | exon | 2882 | 3010 | . | − | 0 | gene_id "SIRV2"; transcript_id "SIRV207"; exon_assignment "SIRV207_4"; |
| SIRV2 | LexogenSIRVData | exon | 3106 | 3374 | . | − | 0 | gene_id "SIRV2"; transcript_id "SIRV207"; exon_assignment "SIRV207_5"; |
| SIRV2 | LexogenSIRVData | exon | 3666 | 3825 | . | − | 0 | gene_id "SIRV2"; transcript_id "SIRV207"; exon_assignment "SIRV207_6"; |
| SIRV2 | LexogenSIRVData | exon | 3967 | 4479 | . | − | 0 | gene_id "SIRV2"; transcript_id "SIRV207"; exon_assignment "SIRV207_7"; |
| SIRV2 | LexogenSIRVData | exon | 4688 | 4732 | . | − | 0 | gene_id "SIRV2"; transcript_id "SIRV207"; exon_assignment "SIRV207_8"; |
| SIRV2 | LexogenSIRVData | exon | 3666 | 3825 | . | − | 0 | gene_id "SIRV2"; transcript_id "SIRV208"; exon_assignment "SIRV208_0"; |
| SIRV2 | LexogenSIRVData | exon | 3967 | 4479 | . | − | 0 | gene_id "SIRV2"; transcript_id "SIRV208"; exon_assignment "SIRV208_1"; |
| SIRV2 | LexogenSIRVData | exon | 4688 | 4800 | . | − | 0 | gene_id "SIRV2"; transcript_id "SIRV208"; exon_assignment "SIRV208_2"; |
| SIRV2 | LexogenSIRVData | exon | 5752 | 5907 | . | − | 0 | gene_id "SIRV2"; transcript_id "SIRV208"; exon_assignment "SIRV208_3"; |
| SIRV2 | LexogenSIRVData | exon | 1001 | 1661 | . | − | 0 | gene_id "SIRV2"; transcript_id "SIRV209"; exon_assignment "SIRV209_0"; |
| SIRV2 | LexogenSIRVData | exon | 1742 | 1853 | . | − | 0 | gene_id "SIRV2"; transcript_id "SIRV209"; exon_assignment "SIRV209_1"; |
| SIRV2 | LexogenSIRVData | exon | 1974 | 2064 | . | − | 0 | gene_id "SIRV2"; transcript_id "SIRV209"; exon_assignment "SIRV209_2"; |
| SIRV2 | LexogenSIRVData | exon | 2675 | 2802 | . | − | 0 | gene_id "SIRV2"; transcript_id "SIRV209"; exon_assignment "SIRV209_3"; |
| SIRV2 | LexogenSIRVData | exon | 2882 | 2911 | . | − | 0 | gene_id "SIRV2"; transcript_id "SIRV209"; exon_assignment "SIRV209_4"; |
| SIRV3 | LexogenSIRVData | exon | 1945 | 2005 | . | + | 0 | gene_id "SIRV3"; transcript_id "SIRV301"; exon_assignment "SIRV301_0"; |
| SIRV3 | LexogenSIRVData | exon | 4569 | 4779 | . | + | 0 | gene_id "SIRV3"; transcript_id "SIRV301"; exon_assignment "SIRV301_1"; |
| SIRV3 | LexogenSIRVData | exon | 6058 | 7988 | . | + | 0 | gene_id "SIRV3"; transcript_id "SIRV301"; exon_assignment "SIRV301_2"; |
| SIRV3 | LexogenSIRVData | exon | 8128 | 8207 | . | + | 0 | gene_id "SIRV3"; transcript_id "SIRV301"; exon_assignment "SIRV301_3"; |
| SIRV3 | LexogenSIRVData | exon | 8756 | 8939 | . | + | 0 | gene_id "SIRV3"; transcript_id "SIRV301"; exon_assignment "SIRV301_4"; |
| SIRV3 | LexogenSIRVData | exon | 1964 | 2005 | . | + | 0 | gene_id "SIRV3"; transcript_id "SIRV302"; exon_assignment "SIRV302_0"; |
| SIRV3 | LexogenSIRVData | exon | 6058 | 7822 | . | + | 0 | gene_id "SIRV3"; transcript_id "SIRV302"; exon_assignment "SIRV302_1"; |
| SIRV3 | LexogenSIRVData | exon | 1964 | 2005 | . | + | 0 | gene_id "SIRV3"; transcript_id "SIRV303"; exon_assignment "SIRV303_0"; |
| SIRV3 | LexogenSIRVData | exon | 4569 | 4779 | . | + | 0 | gene_id "SIRV3"; transcript_id "SIRV303"; exon_assignment "SIRV303_1"; |
| SIRV3 | LexogenSIRVData | exon | 6058 | 7822 | . | + | 0 | gene_id "SIRV3"; transcript_id "SIRV303"; exon_assignment "SIRV303_2"; |
| SIRV3 | LexogenSIRVData | exon | 1964 | 2005 | . | + | 0 | gene_id "SIRV3"; transcript_id "SIRV304"; exon_assignment "SIRV304_0"; |
| SIRV3 | LexogenSIRVData | exon | 4004 | 4080 | . | + | 0 | gene_id "SIRV3"; transcript_id "SIRV304"; exon_assignment "SIRV304_1"; |
| SIRV3 | LexogenSIRVData | exon | 4569 | 4779 | . | + | 0 | gene_id "SIRV3"; transcript_id "SIRV304"; exon_assignment "SIRV304_2"; |
| SIRV3 | LexogenSIRVData | exon | 6058 | 6333 | . | + | 0 | gene_id "SIRV3"; transcript_id "SIRV304"; exon_assignment "SIRV304_3"; |
| SIRV3 | LexogenSIRVData | exon | 7271 | 7366 | . | + | 0 | gene_id "SIRV3"; transcript_id "SIRV304"; exon_assignment "SIRV304_4"; |
| SIRV3 | LexogenSIRVData | exon | 7873 | 7988 | . | + | 0 | gene_id "SIRV3"; transcript_id "SIRV304"; exon_assignment "SIRV304_5"; |
| SIRV3 | LexogenSIRVData | exon | 8125 | 8207 | . | + | 0 | gene_id "SIRV3"; transcript_id "SIRV304"; exon_assignment "SIRV304_6"; |
| SIRV3 | LexogenSIRVData | exon | 8756 | 8937 | . | + | 0 | gene_id "SIRV3"; transcript_id "SIRV304"; exon_assignment "SIRV304_7"; |
| SIRV3 | LexogenSIRVData | exon | 4004 | 4080 | . | + | 0 | gene_id "SIRV3"; transcript_id "SIRV305"; exon_assignment "SIRV305_0"; |
| SIRV3 | LexogenSIRVData | exon | 4569 | 4779 | . | + | 0 | gene_id "SIRV3"; transcript_id "SIRV305"; exon_assignment "SIRV305_1"; |
| SIRV3 | LexogenSIRVData | exon | 6571 | 6718 | . | + | 0 | gene_id "SIRV3"; transcript_id "SIRV305"; exon_assignment "SIRV305_2"; |
| SIRV3 | LexogenSIRVData | exon | 1945 | 2005 | . | + | 0 | gene_id "SIRV3"; transcript_id "SIRV306"; exon_assignment "SIRV306_0"; |

APPENDIX C-continued

GTF file SIRV O

| | | | | | | | | |
|---|---|---|---|---|---|---|---|---|
| SIRV3 | LexogenSIRVData | exon | 4004 | 4080 | . | + | 0 | gene_id "SIRV3"; transcript_id "SIRV306"; exon_assignment "SIRV306_1"; |
| SIRV3 | LexogenSIRVData | exon | 6058 | 8292 | . | + | 0 | gene_id "SIRV3"; transcript_id "SIRV306"; exon_assignment "SIRV306_2"; |
| SIRV3 | LexogenSIRVData | exon | 1964 | 2005 | . | + | 0 | gene_id "SIRV3"; transcript_id "SIRV307"; exon_assignment "SIRV307_0"; |
| SIRV3 | LexogenSIRVData | exon | 4004 | 4080 | . | + | 0 | gene_id "SIRV3"; transcript_id "SIRV307"; exon_assignment "SIRV307_1"; |
| SIRV3 | LexogenSIRVData | exon | 4575 | 4774 | . | + | 0 | gene_id "SIRV3"; transcript_id "SIRV307"; exon_assignment "SIRV307_2"; |
| SIRV3 | LexogenSIRVData | exon | 6058 | 6333 | . | + | 0 | gene_id "SIRV3"; transcript_id "SIRV307"; exon_assignment "SIRV307_3"; |
| SIRV3 | LexogenSIRVData | exon | 8756 | 8939 | . | + | 0 | gene_id "SIRV3"; transcript_id "SIRV307"; exon_assignment "SIRV307_4"; |
| SIRV3 | LexogenSIRVData | exon | 1001 | 1167 | . | − | 0 | gene_id "SIRV3"; transcript_id "SIRV308"; exon_assignment "SIRV308_0"; |
| SIRV3 | LexogenSIRVData | exon | 1533 | 1764 | . | − | 0 | gene_id "SIRV3"; transcript_id "SIRV308"; exon_assignment "SIRV308_1"; |
| SIRV3 | LexogenSIRVData | exon | 1903 | 1982 | . | − | 0 | gene_id "SIRV3"; transcript_id "SIRV308"; exon_assignment "SIRV308_2"; |
| SIRV3 | LexogenSIRVData | exon | 8798 | 8975 | . | − | 0 | gene_id "SIRV3"; transcript_id "SIRV309"; exon_assignment "SIRV309_0"; |
| SIRV3 | LexogenSIRVData | exon | 9190 | 9298 | . | − | 0 | gene_id "SIRV3"; transcript_id "SIRV309"; exon_assignment "SIRV309_1"; |
| SIRV3 | LexogenSIRVData | exon | 9435 | 9943 | . | − | 0 | gene_id "SIRV3"; transcript_id "SIRV309"; exon_assignment "SIRV309_2"; |
| SIRV3 | LexogenSIRVData | exon | 8760 | 8966 | . | − | 0 | gene_id "SIRV3"; transcript_id "SIRV310"; exon_assignment "SIRV310_0"; |
| SIRV3 | LexogenSIRVData | exon | 9190 | 9324 | . | − | 0 | gene_id "SIRV3"; transcript_id "SIRV310"; exon_assignment "SIRV310_1"; |
| SIRV3 | LexogenSIRVData | exon | 9668 | 9914 | . | − | 0 | gene_id "SIRV3"; transcript_id "SIRV310"; exon_assignment "SIRV310_2"; |
| SIRV3 | LexogenSIRVData | exon | 4602 | 4762 | . | − | 0 | gene_id "SIRV3"; transcript_id "SIRV311"; exon_assignment "SIRV311_0"; |
| SIRV3 | LexogenSIRVData | exon | 8798 | 8975 | . | − | 0 | gene_id "SIRV3"; transcript_id "SIRV312"; exon_assignment "SIRV312_0"; |
| SIRV3 | LexogenSIRVData | exon | 9435 | 9943 | . | − | 0 | gene_id "SIRV3"; transcript_id "SIRV312"; exon_assignment "SIRV312_1"; |
| SIRV3 | LexogenSIRVData | exon | 1964 | 2005 | . | + | 0 | gene_id "SIRV3"; transcript_id "SIRV313"; exon_assignment "SIRV313_0"; |
| SIRV3 | LexogenSIRVData | exon | 4004 | 4080 | . | + | 0 | gene_id "SIRV3"; transcript_id "SIRV313"; exon_assignment "SIRV313_1"; |
| SIRV3 | LexogenSIRVData | exon | 4569 | 4779 | . | + | 0 | gene_id "SIRV3"; transcript_id "SIRV313"; exon_assignment "SIRV313_2"; |
| SIRV3 | LexogenSIRVData | exon | 6058 | 6718 | . | + | 0 | gene_id "SIRV3"; transcript_id "SIRV313"; exon_assignment "SIRV313_3"; |
| SIRV3 | LexogenSIRVData | exon | 1945 | 2005 | . | + | 0 | gene_id "SIRV3"; transcript_id "SIRV314"; exon_assignment "SIRV314_0"; |
| SIRV3 | LexogenSIRVData | exon | 4004 | 4080 | . | + | 0 | gene_id "SIRV3"; transcript_id "SIRV314"; exon_assignment "SIRV314_1"; |
| SIRV3 | LexogenSIRVData | exon | 4569 | 4774 | . | + | 0 | gene_id "SIRV3"; transcript_id "SIRV314"; exon_assignment "SIRV314_2"; |
| SIRV3 | LexogenSIRVData | exon | 6058 | 8292 | . | + | 0 | gene_id "SIRV3"; transcript_id "SIRV314"; exon_assignment "SIRV314_3"; |
| SIRV3 | LexogenSIRVData | exon | 4004 | 4080 | . | + | 0 | gene_id "SIRV3"; transcript_id "SIRV315"; exon_assignment "SIRV315_0"; |
| SIRV3 | LexogenSIRVData | exon | 6058 | 7988 | . | + | 0 | gene_id "SIRV3"; transcript_id "SIRV315"; exon_assignment "SIRV315_1"; |
| SIRV3 | LexogenSIRVData | exon | 8128 | 8207 | . | + | 0 | gene_id "SIRV3"; transcript_id "SIRV315"; exon_assignment "SIRV315_2"; |
| SIRV3 | LexogenSIRVData | exon | 8756 | 8939 | . | + | 0 | gene_id "SIRV3"; transcript_id "SIRV315"; exon_assignment "SIRV315_3"; |
| SIRV4 | LexogenSIRVData | exon | 8323 | 8372 | . | − | 0 | gene_id "SIRV4"; transcript_id "SIRV403"; exon_assignment "SIRV403_0"; |
| SIRV4 | LexogenSIRVData | exon | 8630 | 8990 | . | − | 0 | gene_id "SIRV4"; transcript_id "SIRV403"; exon_assignment "SIRV403_1"; |
| SIRV4 | LexogenSIRVData | exon | 13673 | 13828 | . | − | 0 | gene_id "SIRV4"; transcript_id "SIRV403"; exon_assignment "SIRV403_2"; |
| SIRV4 | LexogenSIRVData | exon | 15020 | 15122 | . | − | 0 | gene_id "SIRV4"; transcript_id "SIRV403"; exon_assignment "SIRV403_3"; |
| SIRV4 | LexogenSIRVData | exon | 8323 | 8372 | . | − | 0 | gene_id "SIRV4"; transcript_id "SIRV404"; exon_assignment "SIRV404_0"; |
| SIRV4 | LexogenSIRVData | exon | 8630 | 8990 | . | − | 0 | gene_id "SIRV4"; transcript_id "SIRV404"; exon_assignment "SIRV404_1"; |
| SIRV4 | LexogenSIRVData | exon | 13673 | 13822 | . | − | 0 | gene_id "SIRV4"; transcript_id "SIRV404"; exon_assignment "SIRV404_2"; |
| SIRV4 | LexogenSIRVData | exon | 14593 | 14623 | . | − | 0 | gene_id "SIRV4"; transcript_id "SIRV404"; exon_assignment "SIRV404_3"; |
| SIRV4 | LexogenSIRVData | exon | 8630 | 8990 | . | − | 0 | gene_id "SIRV4"; transcript_id "SIRV405"; exon_assignment "SIRV405_0"; |
| SIRV4 | LexogenSIRVData | exon | 13673 | 13937 | . | − | 0 | gene_id "SIRV4"; transcript_id "SIRV405"; exon_assignment "SIRV405_1"; |
| SIRV4 | LexogenSIRVData | exon | 3638 | 4103 | . | − | 0 | gene_id "SIRV4"; transcript_id "SIRV406"; exon_assignment "SIRV406_0"; |
| SIRV4 | LexogenSIRVData | exon | 5008 | 5158 | . | − | 0 | gene_id "SIRV4"; transcript_id "SIRV406"; exon_assignment "SIRV406_1"; |
| SIRV4 | LexogenSIRVData | exon | 8324 | 8372 | . | − | 0 | gene_id "SIRV4"; transcript_id "SIRV408"; exon_assignment "SIRV408_0"; |
| SIRV4 | LexogenSIRVData | exon | 8630 | 8747 | . | − | 0 | gene_id "SIRV4"; transcript_id "SIRV408"; exon_assignment "SIRV408_1"; |
| SIRV4 | LexogenSIRVData | exon | 8847 | 8990 | . | − | 0 | gene_id "SIRV4"; transcript_id "SIRV408"; exon_assignment "SIRV408_2"; |
| SIRV4 | LexogenSIRVData | exon | 13673 | 13828 | . | − | 0 | gene_id "SIRV4"; transcript_id "SIRV408"; exon_assignment "SIRV408_3"; |
| SIRV4 | LexogenSIRVData | exon | 15020 | 15122 | . | − | 0 | gene_id "SIRV4"; transcript_id "SIRV408"; exon_assignment "SIRV408_4"; |
| SIRV4 | LexogenSIRVData | exon | 1001 | 1346 | . | + | 0 | gene_id "SIRV4"; transcript_id "SIRV409"; exon_assignment "SIRV409_0"; |
| SIRV4 | LexogenSIRVData | exon | 1679 | 1885 | . | + | 0 | gene_id "SIRV4"; transcript_id "SIRV409"; exon_assignment "SIRV409_1"; |
| SIRV4 | LexogenSIRVData | exon | 2390 | 3403 | . | + | 0 | gene_id "SIRV4"; transcript_id "SIRV409"; exon_assignment "SIRV409_2"; |
| SIRV4 | LexogenSIRVData | exon | 1456 | 1885 | . | + | 0 | gene_id "SIRV4"; transcript_id "SIRV410"; exon_assignment "SIRV410_0"; |
| SIRV4 | LexogenSIRVData | exon | 2252 | 2771 | . | + | 0 | gene_id "SIRV4"; transcript_id "SIRV410"; exon_assignment "SIRV410_1"; |
| SIRV4 | LexogenSIRVData | exon | 2455 | 3637 | . | − | 0 | gene_id "SIRV4"; transcript_id "SIRV401"; exon_assignment "SIRV401_0"; |
| SIRV4 | LexogenSIRVData | exon | 4057 | 4103 | . | − | 0 | gene_id "SIRV4"; transcript_id "SIRV401"; exon_assignment "SIRV401_1"; |
| SIRV4 | LexogenSIRVData | exon | 5008 | 5163 | . | − | 0 | gene_id "SIRV4"; transcript_id "SIRV401"; exon_assignment "SIRV401_2"; |
| SIRV4 | LexogenSIRVData | exon | 7642 | 7668 | . | − | 0 | gene_id "SIRV4"; transcript_id "SIRV401"; exon_assignment "SIRV401_3"; |
| SIRV4 | LexogenSIRVData | exon | 7870 | 7918 | . | − | 0 | gene_id "SIRV4"; transcript_id "SIRV401"; exon_assignment "SIRV401_4"; |
| SIRV4 | LexogenSIRVData | exon | 8243 | 8372 | . | − | 0 | gene_id "SIRV4"; transcript_id "SIRV401"; exon_assignment "SIRV401_5"; |
| SIRV4 | LexogenSIRVData | exon | 8630 | 8990 | . | − | 0 | gene_id "SIRV4"; transcript_id "SIRV401"; exon_assignment "SIRV401_6"; |
| SIRV4 | LexogenSIRVData | exon | 13673 | 13822 | . | − | 0 | gene_id "SIRV4"; transcript_id "SIRV401"; exon_assignment "SIRV401_7"; |
| SIRV4 | LexogenSIRVData | exon | 14920 | 15069 | . | − | 0 | gene_id "SIRV4"; transcript_id "SIRV401"; exon_assignment "SIRV401_8"; |
| SIRV4 | LexogenSIRVData | exon | 2458 | 3637 | . | − | 0 | gene_id "SIRV4"; transcript_id "SIRV402"; exon_assignment "SIRV402_0; |
| SIRV4 | LexogenSIRVData | exon | 4057 | 4103 | . | − | 0 | gene_id "SIRV4"; transcript_id "SIRV402"; exon_assignment "SIRV402_1"; |
| SIRV4 | LexogenSIRVData | exon | 5008 | 5839 | . | − | 0 | gene_id "SIRV4"; transcript_id "SIRV402"; exon_assignment "SIRV402_2"; |
| SIRV4 | LexogenSIRVData | exon | 2457 | 3637 | . | − | 0 | gene_id "SIRV4"; transcript_id "SIRV407"; exon_assignment "SIRV407_0; |
| SIRV4 | LexogenSIRVData | exon | 4057 | 4103 | . | − | 0 | gene_id "SIRV4"; transcript_id "SIRV407"; exon_assignment "SIRV407_1"; |
| SIRV4 | LexogenSIRVData | exon | 5008 | 5163 | . | − | 0 | gene_id "SIRV4"; transcript_id "SIRV407"; exon_assignment "SIRV407_2"; |
| SIRV4 | LexogenSIRVData | exon | 7642 | 7668 | . | − | 0 | gene_id "SIRV4"; transcript_id "SIRV407"; exon_assignment "SIRV407_3"; |
| SIRV4 | LexogenSIRVData | exon | 7870 | 7918 | . | − | 0 | gene_id "SIRV4"; transcript_id "SIRV407"; exon_assignment "SIRV407_4; |
| SIRV4 | LexogenSIRVData | exon | 8243 | 8372 | . | − | 0 | gene_id "SIRV4"; transcript_id "SIRV407"; exon_assignment "SIRV407_5; |
| SIRV4 | LexogenSIRVData | exon | 8630 | 8990 | . | + | 0 | gene_id "SIRV4"; transcript_id "SIRV407"; exon_assignment "SIRV407_6"; |
| SIRV4 | LexogenSIRVData | exon | 13673 | 13826 | . | + | 0 | gene_id "SIRV4"; transcript_id "SIRV407"; exon_assignment "SIRV407_7"; |
| SIRV4 | LexogenSIRVData | exon | 1456 | 1885 | . | + | 0 | gene_id "SIRV4"; transcript_id "SIRV411"; exon_assignment "SIRV411_0"; |
| SIRV4 | LexogenSIRVData | exon | 2390 | 3403 | . | + | 0 | gene_id "SIRV4"; transcript_id "SIRV411"; exon_assignment "SIRV411_1"; |
| SIRV5 | LexogenSIRVData | exon | 1057 | 1149 | . | + | 0 | gene_id "SIRV5"; transcript_id "SIRV501"; exon_assignment "SIRV501_0"; |
| SIRV5 | LexogenSIRVData | exon | 1988 | 2033 | . | + | 0 | gene_id "SIRV5"; transcript_id "SIRV501"; exon_assignment "SIRV501_1"; |
| SIRV5 | LexogenSIRVData | exon | 2120 | 2315 | . | + | 0 | gene_id "SIRV5"; transcript_id "SIRV501"; exon_assignment "SIRV501_2"; |

APPENDIX C-continued

| | | | | | | | | |
|---|---|---|---|---|---|---|---|---|
| | | | | GTF file SIRV O | | | | |
| SIRV5 | LexogenSIRVData | exon | 3299 | 3404 | . | + | 0 | gene_id "SIRV5"; transcript_id "SIRV501"; exon_assignment "SIRV501_3"; |
| SIRV5 | LexogenSIRVData | exon | 3484 | 3643 | . | + | 0 | gene_id "SIRV5"; transcript_id "SIRV501"; exon_assignment "SIRV501_4"; |
| SIRV5 | LexogenSIRVData | exon | 5381 | 5450 | . | + | 0 | gene_id "SIRV5"; transcript_id "SIRV501"; exon_assignment "SIRV501_5"; |
| SIRV5 | LexogenSIRVData | exon | 5544 | 5626 | . | + | 0 | gene_id "SIRV5"; transcript_id "SIRV501"; exon_assignment "SIRV501_6"; |
| SIRV5 | LexogenSIRVData | exon | 6112 | 6169 | . | + | 0 | gene_id "SIRV5"; transcript_id "SIRV501"; exon_assignment "SIRV501_7"; |
| SIRV5 | LexogenSIRVData | exon | 6328 | 6452 | . | + | 0 | gene_id "SIRV5"; transcript_id "SIRV501"; exon_assignment "SIRV501_8"; |
| SIRV5 | LexogenSIRVData | exon | 6659 | 6722 | . | + | 0 | gene_id "SIRV5"; transcript_id "SIRV501"; exon_assignment "SIRV501_9"; |
| SIRV5 | LexogenSIRVData | exon | 6827 | 6957 | . | + | 0 | gene_id "SIRV5"; transcript_id "SIRV501"; exon_assignment "SIRV501_10"; |
| SIRV5 | LexogenSIRVData | exon | 7145 | 7307 | . | + | 0 | gene_id "SIRV5"; transcript_id "SIRV501"; exon_assignment "SIRV501_11"; |
| SIRV5 | LexogenSIRVData | exon | 7682 | 7762 | . | + | 0 | gene_id "SIRV5"; transcript_id "SIRV501"; exon_assignment "SIRV501_12"; |
| SIRV5 | LexogenSIRVData | exon | 7871 | 8016 | . | + | 0 | gene_id "SIRV5"; transcript_id "SIRV501"; exon_assignment "SIRV501_13"; |
| SIRV5 | LexogenSIRVData | exon | 8278 | 8381 | . | + | 0 | gene_id "SIRV5"; transcript_id "SIRV501"; exon_assignment "SIRV501_14"; |
| SIRV5 | LexogenSIRVData | exon | 8455 | 8585 | . | + | 0 | gene_id "SIRV5"; transcript_id "SIRV501"; exon_assignment "SIRV501_15"; |
| SIRV5 | LexogenSIRVData | exon | 10859 | 10991 | . | + | 0 | gene_id "SIRV5"; transcript_id "SIRV501"; exon_assignment "SIRV501_16"; |
| SIRV5 | LexogenSIRVData | exon | 1020 | 1149 | . | + | 0 | gene_id "SIRV5"; transcript_id "SIRV502"; exon_assignment "SIRV502_0"; |
| SIRV5 | LexogenSIRVData | exon | 1988 | 2033 | . | + | 0 | gene_id "SIRV5"; transcript_id "SIRV502"; exon_assignment "SIRV502_1"; |
| SIRV5 | LexogenSIRVData | exon | 2120 | 2156 | . | + | 0 | gene_id "SIRV5"; transcript_id "SIRV502"; exon_assignment "SIRV502_2"; |
| SIRV5 | LexogenSIRVData | exon | 2271 | 2488 | . | + | 0 | gene_id "SIRV5"; transcript_id "SIRV502"; exon_assignment "SIRV502_3"; |
| SIRV5 | LexogenSIRVData | exon | 3299 | 3404 | . | + | 0 | gene_id "SIRV5"; transcript_id "SIRV502"; exon_assignment "SIRV502_4"; |
| SIRV5 | LexogenSIRVData | exon | 3484 | 3643 | . | + | 0 | gene_id "SIRV5"; transcript_id "SIRV502"; exon_assignment "SIRV502_5"; |
| SIRV5 | LexogenSIRVData | exon | 5381 | 5450 | . | + | 0 | gene_id "SIRV5"; transcript_id "SIRV502"; exon_assignment "SIRV502_6"; |
| SIRV5 | LexogenSIRVData | exon | 5544 | 5626 | . | + | 0 | gene_id "SIRV5"; transcript_id "SIRV502"; exon_assignment "SIRV502_7"; |
| SIRV5 | LexogenSIRVData | exon | 6112 | 6169 | . | + | 0 | gene_id "SIRV5"; transcript_id "SIRV502"; exon_assignment "SIRV502_8"; |
| SIRV5 | LexogenSIRVData | exon | 6328 | 6452 | . | + | 0 | gene_id "SIRV5"; transcript_id "SIRV502"; exon_assignment "SIRV502_9"; |
| SIRV5 | LexogenSIRVData | exon | 6659 | 6722 | . | + | 0 | gene_id "SIRV5"; transcript_id "SIRV502"; exon_assignment "SIRV502_10"; |
| SIRV5 | LexogenSIRVData | exon | 6827 | 6957 | . | + | 0 | gene_id "SIRV5"; transcript_id "SIRV502"; exon_assignment "SIRV502_11"; |
| SIRV5 | LexogenSIRVData | exon | 7145 | 7307 | . | + | 0 | gene_id "SIRV5"; transcript_id "SIRV502"; exon_assignment "SIRV502_12"; |
| SIRV5 | LexogenSIRVData | exon | 7682 | 7762 | . | + | 0 | gene_id "SIRV5"; transcript_id "SIRV502"; exon_assignment "SIRV502_13"; |
| SIRV5 | LexogenSIRVData | exon | 7871 | 8016 | . | + | 0 | gene_id "SIRV5"; transcript_id "SIRV502"; exon_assignment "SIRV502_14"; |
| SIRV5 | LexogenSIRVData | exon | 8278 | 8381 | . | + | 0 | gene_id "SIRV5"; transcript_id "SIRV502"; exon_assignment "SIRV502_15"; |
| SIRV5 | LexogenSIRVData | exon | 8455 | 8585 | . | + | 0 | gene_id "SIRV5"; transcript_id "SIRV502"; exon_assignment "SIRV502_16"; |
| SIRV5 | LexogenSIRVData | exon | 10859 | 10989 | . | + | 0 | gene_id "SIRV5"; transcript_id "SIRV502"; exon_assignment "SIRV502_17"; |
| SIRV5 | LexogenSIRVData | exon | 8202 | 8585 | . | + | 0 | gene_id "SIRV5"; transcript_id "SIRV503"; exon_assignment "SIRV503_0"; |
| SIRV5 | LexogenSIRVData | exon | 10859 | 10991 | . | + | 0 | gene_id "SIRV5"; transcript_id "SIRV503"; exon_assignment "SIRV503_1"; |
| SIRV5 | LexogenSIRVData | exon | 11134 | 11142 | . | + | 0 | gene_id "SIRV5"; transcript_id "SIRV503"; exon_assignment "SIRV503_2"; |
| SIRV5 | LexogenSIRVData | exon | 11134 | 13606 | . | + | 0 | gene_id "SIRV5"; transcript_id "SIRV504"; exon_assignment "SIRV504_0"; |
| SIRV5 | LexogenSIRVData | exon | 1001 | 1149 | . | + | 0 | gene_id "SIRV5"; transcript_id "SIRV505"; exon_assignment "SIRV505_0"; |
| SIRV5 | LexogenSIRVData | exon | 1988 | 2033 | . | + | 0 | gene_id "SIRV5"; transcript_id "SIRV505"; exon_assignment "SIRV505_1"; |
| SIRV5 | LexogenSIRVData | exon | 2120 | 2156 | . | + | 0 | gene_id "SIRV5"; transcript_id "SIRV505"; exon_assignment "SIRV505_2; |
| SIRV5 | LexogenSIRVData | exon | 2271 | 2315 | . | + | 0 | gene_id "SIRV5"; transcript_id "SIRV505"; exon_assignment "SIRV505_3"; |
| SIRV5 | LexogenSIRVData | exon | 3299 | 3404 | . | + | 0 | gene_id "SIRV5"; transcript_id "SIRV505"; exon_assignment "SIRV505_4; |
| SIRV5 | LexogenSIRVData | exon | 3484 | 3643 | . | + | 0 | gene_id "SIRV5"; transcript_id "SIRV505"; exon_assignment "SIRV505_5"; |
| SIRV5 | LexogenSIRVData | exon | 5381 | 5450 | . | + | 0 | gene_id "SIRV5"; transcript_id "SIRV505"; exon_assignment "SIRV505_6"; |
| SIRV5 | LexogenSIRVData | exon | 5544 | 5626 | . | + | 0 | gene_id "SIRV5"; transcript_id "SIRV505"; exon_assignment "SIRV505_7"; |
| SIRV5 | LexogenSIRVData | exon | 6112 | 6169 | . | + | 0 | gene_id "SIRV5"; transcript_id "SIRV505"; exon_assignment "SIRV505_8"; |
| SIRV5 | LexogenSIRVData | exon | 6328 | 6452 | . | + | 0 | gene_id "SIRV5"; transcript_id "SIRV505"; exon_assignment "SIRV505_9"; |
| SIRV5 | LexogenSIRVData | exon | 6827 | 6957 | . | + | 0 | gene_id "SIRV5"; transcript_id "SIRV505"; exon_assignment "SIRV505_10"; |
| SIRV5 | LexogenSIRVData | exon | 7145 | 7307 | . | + | 0 | gene_id "SIRV5"; transcript_id "SIRV505"; exon_assignment "SIRV505_11"; |
| SIRV5 | LexogenSIRVData | exon | 7682 | 7762 | . | + | 0 | gene_id "SIRV5"; transcript_id "SIRV505"; exon_assignment "SIRV505_12"; |
| SIRV5 | LexogenSIRVData | exon | 7871 | 8381 | . | + | 0 | gene_id "SIRV5"; transcript_id "SIRV505"; exon_assignment "SIRV505_13"; |
| SIRV5 | LexogenSIRVData | exon | 8455 | 8585 | . | + | 0 | gene_id "SIRV5"; transcript_id "SIRV505"; exon_assignment "SIRV505_14"; |
| SIRV5 | LexogenSIRVData | exon | 10859 | 10991 | . | + | 0 | gene_id "SIRV5"; transcript_id "SIRV505"; exon_assignment "SIRV505_15"; |
| SIRV5 | LexogenSIRVData | exon | 1009 | 1149 | . | + | 0 | gene_id "SIRV5"; transcript_id "SIRV506"; exon_assignment "SIRV506_0"; |
| SIRV5 | LexogenSIRVData | exon | 1988 | 2398 | . | + | 0 | gene_id "SIRV5"; transcript_id "SIRV506"; exon_assignment "SIRV506_1"; |
| SIRV5 | LexogenSIRVData | exon | 1028 | 1149 | . | + | 0 | gene_id "SIRV5"; transcript_id "SIRV507"; exon_assignment "SIRV507_0"; |
| SIRV5 | LexogenSIRVData | exon | 1926 | 2033 | . | + | 0 | gene_id "SIRV5"; transcript_id "SIRV507"; exon_assignment "SIRV507_1"; |
| SIRV5 | LexogenSIRVData | exon | 2120 | 2156 | . | + | 0 | gene_id "SIRV5"; transcript_id "SIRV507"; exon_assignment "SIRV507_2"; |
| SIRV5 | LexogenSIRVData | exon | 2271 | 2315 | . | + | 0 | gene_id "SIRV5"; transcript_id "SIRV507"; exon_assignment "SIRV507_3"; |
| SIRV5 | LexogenSIRVData | exon | 3299 | 3404 | . | + | 0 | gene_id "SIRV5"; transcript_id "SIRV507"; exon_assignment "SIRV507_4"; |
| SIRV5 | LexogenSIRVData | exon | 3484 | 3598 | . | + | 0 | gene_id "SIRV5"; transcript_id "SIRV507"; exon_assignment "SIRV507_5"; |
| SIRV5 | LexogenSIRVData | exon | 1009 | 1149 | . | + | 0 | gene_id "SIRV5"; transcript_id "SIRV508"; exon_assignment "SIRV508_0"; |
| SIRV5 | LexogenSIRVData | exon | 1988 | 2033 | . | + | 0 | gene_id "SIRV5"; transcript_id "SIRV508"; exon_assignment "SIRV508_1"; |
| SIRV5 | LexogenSIRVData | exon | 2120 | 2156 | . | + | 0 | gene_id "SIRV5"; transcript_id "SIRV508"; exon_assignment "SIRV508_2"; |
| SIRV5 | LexogenSIRVData | exon | 2271 | 2315 | . | + | 0 | gene_id "SIRV5"; transcript_id "SIRV508"; exon_assignment "SIRV508_3"; |
| SIRV5 | LexogenSIRVData | exon | 3299 | 3404 | . | + | 0 | gene_id "SIRV5"; transcript_id "SIRV508"; exon_assignment "SIRV508_4"; |
| SIRV5 | LexogenSIRVData | exon | 3484 | 3643 | . | + | 0 | gene_id "SIRV5"; transcript_id "SIRV508"; exon_assignment "SIRV508_5"; |
| SIRV5 | LexogenSIRVData | exon | 5381 | 5450 | . | + | 0 | gene_id "SIRV5"; transcript_id "SIRV508"; exon_assignment "SIRV508_6"; |
| SIRV5 | LexogenSIRVData | exon | 5544 | 5626 | . | + | 0 | gene_id "SIRV5"; transcript_id "SIRV508"; exon_assignment "SIRV508_7"; |
| SIRV5 | LexogenSIRVData | exon | 6112 | 6169 | . | + | 0 | gene_id "SIRV5"; transcript_id "SIRV508"; exon_assignment "SIRV508_8"; |
| SIRV5 | LexogenSIRVData | exon | 6328 | 6452 | . | + | 0 | gene_id "SIRV5"; transcript_id "SIRV508"; exon_assignment "SIRV508_9"; |
| SIRV5 | LexogenSIRVData | exon | 6659 | 6722 | . | + | 0 | gene_id "SIRV5"; transcript_id "SIRV508"; exon_assignment "SIRV508_10"; |
| SIRV5 | LexogenSIRVData | exon | 6827 | 6957 | . | + | 0 | gene_id "SIRV5"; transcript_id "SIRV508"; exon_assignment "SIRV508_11"; |
| SIRV5 | LexogenSIRVData | exon | 7145 | 7307 | . | + | 0 | gene_id "SIRV5"; transcript_id "SIRV508"; exon_assignment "SIRV508_12"; |
| SIRV5 | LexogenSIRVData | exon | 7682 | 7762 | . | + | 0 | gene_id "SIRV5"; transcript_id "SIRV508"; exon_assignment "SIRV508_13"; |
| SIRV5 | LexogenSIRVData | exon | 7871 | 8381 | . | + | 0 | gene_id "SIRV5"; transcript_id "SIRV508"; exon_assignment "SIRV508_14"; |
| SIRV5 | LexogenSIRVData | exon | 8455 | 8585 | . | + | 0 | gene_id "SIRV5"; transcript_id "SIRV508"; exon_assignment "SIRV508_15"; |
| SIRV5 | LexogenSIRVData | exon | 10859 | 10991 | . | + | 0 | gene_id "SIRV5"; transcript_id "SIRV508"; exon_assignment "SIRV508_16"; |
| SIRV5 | LexogenSIRVData | exon | 8316 | 8381 | . | + | 0 | gene_id "SIRV5"; transcript_id "SIRV509"; exon_assignment "SIRV509_0"; |

APPENDIX C-continued

GTF file SIRV O

| | | | | | | | | |
|---|---|---|---|---|---|---|---|---|
| SIRV5 | LexogenSIRVData | exon | 8455 | 8585 | . | + | 0 | gene_id "SIRV5"; transcript_id "SIRV509"; exon_assignment "SIRV509_1"; |
| SIRV5 | LexogenSIRVData | exon | 10859 | 10991 | . | + | 0 | gene_id "SIRV5"; transcript_id "SIRV509"; exon_assignment "SIRV509_2"; |
| SIRV5 | LexogenSIRVData | exon | 11312 | 11866 | . | + | 0 | gene_id "SIRV5"; transcript_id "SIRV509"; exon_assignment "SIRV509_3"; |
| SIRV5 | LexogenSIRVData | exon | 1029 | 1149 | . | + | 0 | gene_id "SIRV5"; transcript_id "SIRV510"; exon_assignment "SIRV510_0"; |
| SIRV5 | LexogenSIRVData | exon | 1988 | 2033 | . | + | 0 | gene_id "SIRV5"; transcript_id "SIRV510"; exon_assignment "SIRV510_1"; |
| SIRV5 | LexogenSIRVData | exon | 2120 | 2156 | . | + | 0 | gene_id "SIRV5"; transcript_id "SIRV510"; exon_assignment "SIRV510_2"; |
| SIRV5 | LexogenSIRVData | exon | 2271 | 2315 | . | + | 0 | gene_id "SIRV5"; transcript_id "SIRV510"; exon_assignment "SIRV510_3"; |
| SIRV5 | LexogenSIRVData | exon | 3299 | 3404 | . | + | 0 | gene_id "SIRV5"; transcript_id "SIRV510"; exon_assignment "SIRV510_4"; |
| SIRV5 | LexogenSIRVData | exon | 3484 | 3643 | . | + | 0 | gene_id "SIRV5"; transcript_id "SIRV510"; exon_assignment "SIRV510_5"; |
| SIRV5 | LexogenSIRVData | exon | 5381 | 5450 | . | + | 0 | gene_id "SIRV5"; transcript_id "SIRV510"; exon_assignment "SIRV510_6"; |
| SIRV5 | LexogenSIRVData | exon | 5544 | 5626 | . | + | 0 | gene_id "SIRV5"; transcript_id "SIRV510"; exon_assignment "SIRV510_7"; |
| SIRV5 | LexogenSIRVData | exon | 6112 | 6169 | . | + | 0 | gene_id "SIRV5"; transcript_id "SIRV510"; exon_assignment "SIRV510_8"; |
| SIRV5 | LexogenSIRVData | exon | 6328 | 6452 | . | + | 0 | gene_id "SIRV5"; transcript_id "SIRV510"; exon_assignment "SIRV510_9"; |
| SIRV5 | LexogenSIRVData | exon | 6827 | 6957 | . | + | 0 | gene_id "SIRV5"; transcript_id "SIRV510"; exon_assignment "SIRV510_10"; |
| SIRV5 | LexogenSIRVData | exon | 7145 | 7307 | . | + | 0 | gene_id "SIRV5"; transcript_id "SIRV510"; exon_assignment "SIRV510_11"; |
| SIRV5 | LexogenSIRVData | exon | 7682 | 7762 | . | + | 0 | gene_id "SIRV5"; transcript_id "SIRV510"; exon_assignment "SIRV510_12"; |
| SIRV5 | LexogenSIRVData | exon | 7871 | 8016 | . | + | 0 | gene_id "SIRV5"; transcript_id "SIRV510"; exon_assignment "SIRV510_13"; |
| SIRV5 | LexogenSIRVData | exon | 8278 | 8381 | . | + | 0 | gene_id "SIRV5"; transcript_id "SIRV510"; exon_assignment "SIRV510_14"; |
| SIRV5 | LexogenSIRVData | exon | 8455 | 8585 | . | + | 0 | gene_id "SIRV5"; transcript_id "SIRV510"; exon_assignment "SIRV510_15"; |
| SIRV5 | LexogenSIRVData | exon | 10859 | 10991 | . | + | 0 | gene_id "SIRV5"; transcript_id "SIRV510"; exon_assignment "SIRV510_16"; |
| SIRV5 | LexogenSIRVData | exon | 11134 | 11867 | . | + | 0 | gene_id "SIRV5"; transcript_id "SIRV510"; exon_assignment "SIRV510_17"; |
| SIRV5 | LexogenSIRVData | exon | 1009 | 1143 | . | + | 0 | gene_id "SIRV5"; transcript_id "SIRV511"; exon_assignment "SIRV511_0"; |
| SIRV5 | LexogenSIRVData | exon | 1988 | 2398 | . | + | 0 | gene_id "SIRV5"; transcript_id "SIRV511"; exon_assignment "SIRV511_1"; |
| SIRV5 | LexogenSIRVData | exon | 2178 | 2406 | . | − | 0 | gene_id "SIRV5"; transcript_id "SIRV512"; exon_assignment "SIRV512_0"; |
| SIRV5 | LexogenSIRVData | exon | 1001 | 1149 | . | + | 0 | gene_id "SIRV5"; transcript_id "SIRV513"; exon_assignment "SIRV513_0"; |
| SIRV5 | LexogenSIRVData | exon | 1926 | 2488 | . | + | 0 | gene_id "SIRV5"; transcript_id "SIRV513"; exon_assignment "SIRV513_1"; |
| SIRV5 | LexogenSIRVData | exon | 3299 | 3404 | . | + | 0 | gene_id "SIRV5"; transcript_id "SIRV513"; exon_assignment "SIRV513_2"; |
| SIRV5 | LexogenSIRVData | exon | 3484 | 3643 | . | + | 0 | gene_id "SIRV5"; transcript_id "SIRV513"; exon_assignment "SIRV513_3"; |
| SIRV5 | LexogenSIRVData | exon | 5381 | 5450 | . | + | 0 | gene_id "SIRV5"; transcript_id "SIRV513"; exon_assignment "SIRV513_4"; |
| SIRV5 | LexogenSIRVData | exon | 5544 | 5626 | . | + | 0 | gene_id "SIRV5"; transcript_id "SIRV513"; exon_assignment "SIRV513_5"; |
| SIRV5 | LexogenSIRVData | exon | 6112 | 6169 | . | + | 0 | gene_id "SIRV5"; transcript_id "SIRV513"; exon_assignment "SIRV513_6"; |
| SIRV5 | LexogenSIRVData | exon | 6328 | 6452 | . | + | 0 | gene_id "SIRV5"; transcript_id "SIRV513"; exon_assignment "SIRV513_7"; |
| SIRV5 | LexogenSIRVData | exon | 6659 | 6722 | . | + | 0 | gene_id "SIRV5"; transcript_id "SIRV513"; exon_assignment "SIRV513_8"; |
| SIRV5 | LexogenSIRVData | exon | 6827 | 6957 | . | + | 0 | gene_id "SIRV5"; transcript_id "SIRV513"; exon_assignment "SIRV513_9"; |
| SIRV5 | LexogenSIRVData | exon | 7145 | 7307 | . | + | 0 | gene_id "SIRV5"; transcript_id "SIRV513"; exon_assignment "SIRV513_10"; |
| SIRV5 | LexogenSIRVData | exon | 7682 | 7762 | . | + | 0 | gene_id "SIRV5"; transcript_id "SIRV513"; exon_assignment "SIRV513_11"; |
| SIRV5 | LexogenSIRVData | exon | 7871 | 8585 | . | + | 0 | gene_id "SIRV5"; transcript_id "SIRV513"; exon_assignment "SIRV513_12"; |
| SIRV5 | LexogenSIRVData | exon | 10859 | 10991 | . | + | 0 | gene_id "SIRV5"; transcript_id "SIRV513"; exon_assignment "SIRV513_13"; |
| SIRV5 | LexogenSIRVData | exon | 11312 | 11866 | . | + | 0 | gene_id "SIRV5"; transcript_id "SIRV513"; exon_assignment "SIRV513_14"; |
| SIRV5 | LexogenSIRVData | exon | 1057 | 1149 | . | + | 0 | gene_id "SIRV5"; transcript_id "SIRV514"; exon_assignment "SIRV514_0"; |
| SIRV5 | LexogenSIRVData | exon | 1988 | 2033 | . | + | 0 | gene_id "SIRV5"; transcript_id "SIRV514"; exon_assignment "SIRV514_1"; |
| SIRV5 | LexogenSIRVData | exon | 2120 | 2315 | . | + | 0 | gene_id "SIRV5"; transcript_id "SIRV514"; exon_assignment "SIRV514_2"; |
| SIRV5 | LexogenSIRVData | exon | 3299 | 3404 | . | + | 0 | gene_id "SIRV5"; transcript_id "SIRV514"; exon_assignment "SIRV514_3"; |
| SIRV5 | LexogenSIRVData | exon | 3484 | 3643 | . | + | 0 | gene_id "SIRV5"; transcript_id "SIRV514"; exon_assignment "SIRV514_4"; |
| SIRV5 | LexogenSIRVData | exon | 5544 | 5626 | . | + | 0 | gene_id "SIRV5"; transcript_id "SIRV514"; exon_assignment "SIRV514_5"; |
| SIRV5 | LexogenSIRVData | exon | 6112 | 6169 | . | + | 0 | gene_id "SIRV5"; transcript_id "SIRV514"; exon_assignment "SIRV514_6"; |
| SIRV5 | LexogenSIRVData | exon | 6328 | 6452 | . | + | 0 | gene_id "SIRV5"; transcript_id "SIRV514"; exon_assignment "SIRV514_7"; |
| SIRV5 | LexogenSIRVData | exon | 6659 | 6722 | . | + | 0 | gene_id "SIRV5"; transcript_id "SIRV514"; exon_assignment "SIRV514_8"; |
| SIRV5 | LexogenSIRVData | exon | 6827 | 6957 | . | + | 0 | gene_id "SIRV5"; transcript_id "SIRV514"; exon_assignment "SIRV514_9"; |
| SIRV5 | LexogenSIRVData | exon | 7145 | 7307 | . | + | 0 | gene_id "SIRV5"; transcript_id "SIRV514"; exon_assignment "SIRV514_10"; |
| SIRV5 | LexogenSIRVData | exon | 7682 | 7762 | . | + | 0 | gene_id "SIRV5"; transcript_id "SIRV514"; exon_assignment "SIRV514_11"; |
| SIRV5 | LexogenSIRVData | exon | 7871 | 8585 | . | + | 0 | gene_id "SIRV5"; transcript_id "SIRV514"; exon_assignment "SIRV514_12"; |
| SIRV5 | LexogenSIRVData | exon | 10859 | 10991 | . | + | 0 | gene_id "SIRV5"; transcript_id "SIRV514"; exon_assignment "SIRV514_13"; |
| SIRV5 | LexogenSIRVData | exon | 11134 | 13606 | . | + | 0 | gene_id "SIRV5"; transcript_id "SIRV514"; exon_assignment "SIRV514_14"; |
| SIRV5 | LexogenSIRVData | exon | 1057 | 1149 | . | + | 0 | gene_id "SIRV5"; transcript_id "SIRV515"; exon_assignment "SIRV515_0"; |
| SIRV5 | LexogenSIRVData | exon | 1988 | 2033 | . | + | 0 | gene_id "SIRV5"; transcript_id "SIRV515"; exon_assignment "SIRV515_1"; |
| SIRV5 | LexogenSIRVData | exon | 2120 | 2315 | . | + | 0 | gene_id "SIRV5"; transcript_id "SIRV515"; exon_assignment "SIRV515_2"; |
| SIRV5 | LexogenSIRVData | exon | 3299 | 3404 | . | + | 0 | gene_id "SIRV5"; transcript_id "SIRV515"; exon_assignment "SIRV515_3"; |
| SIRV5 | LexogenSIRVData | exon | 3484 | 3643 | . | + | 0 | gene_id "SIRV5"; transcript_id "SIRV515"; exon_assignment "SIRV515_4"; |
| SIRV5 | LexogenSIRVData | exon | 5544 | 5626 | . | + | 0 | gene_id "SIRV5"; transcript_id "SIRV515"; exon_assignment "SIRV515_5"; |
| SIRV5 | LexogenSIRVData | exon | 6112 | 6169 | . | + | 0 | gene_id "SIRV5"; transcript_id "SIRV515"; exon_assignment "SIRV515_6"; |
| SIRV5 | LexogenSIRVData | exon | 6328 | 6452 | . | + | 0 | gene_id "SIRV5"; transcript_id "SIRV515"; exon_assignment "SIRV515_7"; |
| SIRV5 | LexogenSIRVData | exon | 6659 | 6722 | . | + | 0 | gene_id "SIRV5"; transcript_id "SIRV515"; exon_assignment "SIRV515_8"; |
| SIRV5 | LexogenSIRVData | exon | 6827 | 6957 | . | + | 0 | gene_id "SIRV5"; transcript_id "SIRV515"; exon_assignment "SIRV515_9"; |
| SIRV5 | LexogenSIRVData | exon | 7145 | 7307 | . | + | 0 | gene_id "SIRV5"; transcript_id "SIRV515"; exon_assignment "SIRV515_10"; |
| SIRV5 | LexogenSIRVData | exon | 7682 | 7762 | . | + | 0 | gene_id "SIRV5"; transcript_id "SIRV515"; exon_assignment "SIRV515_11"; |
| SIRV5 | LexogenSIRVData | exon | 7871 | 8585 | . | + | 0 | gene_id "SIRV5"; transcript_id "SIRV515"; exon_assignment "SIRV515_12"; |
| SIRV5 | LexogenSIRVData | exon | 10859 | 10991 | . | + | 0 | gene_id "SIRV5"; transcript_id "SIRV515"; exon_assignment "SIRV515_13"; |
| SIRV5 | LexogenSIRVData | exon | 11134 | 11309 | . | + | 0 | gene_id "SIRV5"; transcript_id "SIRV515"; exon_assignment "SIRV515_14"; |
| SIRV5 | LexogenSIRVData | exon | 8202 | 8585 | . | + | 0 | gene_id "SIRV5"; transcript_id "SIRV516"; exon_assignment "SIRV516_0"; |
| SIRV5 | LexogenSIRVData | exon | 10859 | 10991 | . | + | 0 | gene_id "SIRV5"; transcript_id "SIRV516"; exon_assignment "SIRV516_1"; |
| SIRV5 | LexogenSIRVData | exon | 11134 | 13606 | . | + | 0 | gene_id "SIRV5"; transcript_id "SIRV516"; exon_assignment "SIRV516_2"; |
| SIRV5 | LexogenSIRVData | exon | 1057 | 1149 | . | + | 0 | gene_id "SIRV5"; transcript_id "SIRV517"; exon_assignment "SIRV517_0"; |
| SIRV5 | LexogenSIRVData | exon | 1988 | 2033 | . | + | 0 | gene_id "SIRV5"; transcript_id "SIRV517"; exon_assignment "SIRV517_1"; |
| SIRV5 | LexogenSIRVData | exon | 2120 | 2156 | . | + | 0 | gene_id "SIRV5"; transcript_id "SIRV517"; exon_assignment "SIRV517_2"; |
| SIRV5 | LexogenSIRVData | exon | 2271 | 2488 | . | + | 0 | gene_id "SIRV5"; transcript_id "SIRV517"; exon_assignment "SIRV517_3"; |
| SIRV5 | LexogenSIRVData | exon | 3299 | 3404 | . | + | 0 | gene_id "SIRV5"; transcript_id "SIRV517"; exon_assignment "SIRV517_4"; |
| SIRV5 | LexogenSIRVData | exon | 3484 | 3643 | . | + | 0 | gene_id "SIRV5"; transcript_id "SIRV517"; exon_assignment "SIRV517_5"; |

APPENDIX C-continued

GTF file SIRV O

| | | | | | | | | |
|---|---|---|---|---|---|---|---|---|
| SIRV5 | LexogenSIRVData | exon | 5381 | 5450 | . | + | 0 | gene_id "SIRV5"; transcript_id "SIRV517"; exon_assignment "SIRV517_6"; |
| SIRV5 | LexogenSIRVData | exon | 5544 | 5626 | . | + | 0 | gene_id "SIRV5"; transcript_id "SIRV517"; exon_assignment "SIRV517_7"; |
| SIRV5 | LexogenSIRVData | exon | 6112 | 6169 | . | + | 0 | gene_id "SIRV5"; transcript_id "SIRV517"; exon_assignment "SIRV517_8"; |
| SIRV5 | LexogenSIRVData | exon | 6328 | 6452 | . | + | 0 | gene_id "SIRV5"; transcript_id "SIRV517"; exon_assignment "SIRV517_9"; |
| SIRV5 | LexogenSIRVData | exon | 6659 | 6722 | . | + | 0 | gene_id "SIRV5"; transcript_id "SIRV517"; exon_assignment "SIRV517_10"; |
| SIRV5 | LexogenSIRVData | exon | 6827 | 6957 | . | + | 0 | gene_id "SIRV5"; transcript_id "SIRV517"; exon_assignment "SIRV517_11"; |
| SIRV5 | LexogenSIRVData | exon | 7145 | 7307 | . | + | 0 | gene_id "SIRV5"; transcript_id "SIRV517"; exon_assignment "SIRV517_12"; |
| SIRV5 | LexogenSIRVData | exon | 7682 | 7762 | . | + | 0 | gene_id "SIRV5"; transcript_id "SIRV517"; exon_assignment "SIRV517_13"; |
| SIRV5 | LexogenSIRVData | exon | 7871 | 8381 | . | + | 0 | gene_id "SIRV5"; transcript_id "SIRV517"; exon_assignment "SIRV517_14"; |
| SIRV5 | LexogenSIRVData | exon | 8455 | 8585 | . | + | 0 | gene_id "SIRV5"; transcript_id "SIRV517"; exon_assignment "SIRV517_15"; |
| SIRV5 | LexogenSIRVData | exon | 10859 | 10989 | . | + | 0 | gene_id "SIRV5"; transcript_id "SIRV517"; exon_assignment "SIRV517_16"; |
| SIRV6 | LexogenSIRVData | exon | 1001 | 1186 | . | + | 0 | gene_id "SIRV6"; transcript_id "SIRV601"; exon_assignment "SIRV601_0"; |
| SIRV6 | LexogenSIRVData | exon | 1469 | 1534 | . | + | 0 | gene_id "SIRV6"; transcript_id "SIRV601"; exon_assignment "SIRV601_1"; |
| SIRV6 | LexogenSIRVData | exon | 1641 | 1735 | . | + | 0 | gene_id "SIRV6"; transcript_id "SIRV601"; exon_assignment "SIRV601_2"; |
| SIRV6 | LexogenSIRVData | exon | 2471 | 2620 | . | + | 0 | gene_id "SIRV6"; transcript_id "SIRV601"; exon_assignment "SIRV601_3"; |
| SIRV6 | LexogenSIRVData | exon | 2741 | 2828 | . | + | 0 | gene_id "SIRV6"; transcript_id "SIRV601"; exon_assignment "SIRV601_4"; |
| SIRV6 | LexogenSIRVData | exon | 3107 | 3164 | . | + | 0 | gene_id "SIRV6"; transcript_id "SIRV601"; exon_assignment "SIRV601_5"; |
| SIRV6 | LexogenSIRVData | exon | 10725 | 10818 | . | + | 0 | gene_id "SIRV6"; transcript_id "SIRV601"; exon_assignment "SIRV601_6"; |
| SIRV6 | LexogenSIRVData | exon | 11032 | 11108 | . | + | 0 | gene_id "SIRV6"; transcript_id "SIRV601"; exon_assignment "SIRV601_7"; |
| SIRV6 | LexogenSIRVData | exon | 11206 | 11826 | . | + | 0 | gene_id "SIRV6"; transcript_id "SIRV601"; exon_assignment "SIRV601_8"; |
| SIRV6 | LexogenSIRVData | exon | 1125 | 1186 | . | + | 0 | gene_id "SIRV6"; transcript_id "SIRV602"; exon_assignment "SIRV602_0"; |
| SIRV6 | LexogenSIRVData | exon | 1469 | 1534 | . | + | 0 | gene_id "SIRV6"; transcript_id "SIRV602"; exon_assignment "SIRV602_1"; |
| SIRV6 | LexogenSIRVData | exon | 1641 | 1735 | . | + | 0 | gene_id "SIRV6"; transcript_id "SIRV602"; exon_assignment "SIRV602_2"; |
| SIRV6 | LexogenSIRVData | exon | 2781 | 2828 | . | + | 0 | gene_id "SIRV6"; transcript_id "SIRV602"; exon_assignment "SIRV602_3"; |
| SIRV6 | LexogenSIRVData | exon | 3107 | 3164 | . | + | 0 | gene_id "SIRV6"; transcript_id "SIRV602"; exon_assignment "SIRV602_4"; |
| SIRV6 | LexogenSIRVData | exon | 10725 | 10818 | . | + | 0 | gene_id "SIRV6"; transcript_id "SIRV602"; exon_assignment "SIRV602_5"; |
| SIRV6 | LexogenSIRVData | exon | 11032 | 11108 | . | + | 0 | gene_id "SIRV6"; transcript_id "SIRV602"; exon_assignment "SIRV602_6"; |
| SIRV6 | LexogenSIRVData | exon | 11206 | 11279 | . | + | 0 | gene_id "SIRV6"; transcript_id "SIRV602"; exon_assignment "SIRV602_7"; |
| SIRV6 | LexogenSIRVData | exon | 9000 | 10968 | . | + | 0 | gene_id "SIRV6"; transcript_id "SIRV603"; exon_assignment "SIRV603_0"; |
| SIRV6 | LexogenSIRVData | exon | 1088 | 1186 | . | + | 0 | gene_id "SIRV6"; transcript_id "SIRV604"; exon_assignment "SIRV604_0"; |
| SIRV6 | LexogenSIRVData | exon | 1469 | 1534 | . | + | 0 | gene_id "SIRV6"; transcript_id "SIRV604"; exon_assignment "SIRV604_1"; |
| SIRV6 | LexogenSIRVData | exon | 1641 | 1735 | . | + | 0 | gene_id "SIRV6"; transcript_id "SIRV604"; exon_assignment "SIRV604_2"; |
| SIRV6 | LexogenSIRVData | exon | 1846 | 2026 | . | + | 0 | gene_id "SIRV6"; transcript_id "SIRV604"; exon_assignment "SIRV604_3"; |
| SIRV6 | LexogenSIRVData | exon | 2471 | 2620 | . | + | 0 | gene_id "SIRV6"; transcript_id "SIRV604"; exon_assignment "SIRV604_4"; |
| SIRV6 | LexogenSIRVData | exon | 2741 | 2828 | . | + | 0 | gene_id "SIRV6"; transcript_id "SIRV604"; exon_assignment "SIRV604_5"; |
| SIRV6 | LexogenSIRVData | exon | 3107 | 3164 | . | + | 0 | gene_id "SIRV6"; transcript_id "SIRV604"; exon_assignment "SIRV604_6"; |
| SIRV6 | LexogenSIRVData | exon | 10725 | 10818 | . | + | 0 | gene_id "SIRV6"; transcript_id "SIRV604"; exon_assignment "SIRV604_7"; |
| SIRV6 | LexogenSIRVData | exon | 11035 | 11108 | . | + | 0 | gene_id "SIRV6"; transcript_id "SIRV604"; exon_assignment "SIRV604_8"; |
| SIRV6 | LexogenSIRVData | exon | 11206 | 11837 | . | + | 0 | gene_id "SIRV6"; transcript_id "SIRV604"; exon_assignment "SIRV604_9"; |
| SIRV6 | LexogenSIRVData | exon | 1131 | 1186 | . | + | 0 | gene_id "SIRV6"; transcript_id "SIRV605"; exon_assignment "SIRV605_0"; |
| SIRV6 | LexogenSIRVData | exon | 1469 | 1534 | . | + | 0 | gene_id "SIRV6"; transcript_id "SIRV605"; exon_assignment "SIRV605_1"; |
| SIRV6 | LexogenSIRVData | exon | 1641 | 1735 | . | + | 0 | gene_id "SIRV6"; transcript_id "SIRV605"; exon_assignment "SIRV605_2"; |
| SIRV6 | LexogenSIRVData | exon | 1846 | 2026 | . | + | 0 | gene_id "SIRV6"; transcript_id "SIRV605"; exon_assignment "SIRV605_3"; |
| SIRV6 | LexogenSIRVData | exon | 2471 | 2620 | . | + | 0 | gene_id "SIRV6"; transcript_id "SIRV605"; exon_assignment "SIRV605_4"; |
| SIRV6 | LexogenSIRVData | exon | 2741 | 2828 | . | + | 0 | gene_id "SIRV6"; transcript_id "SIRV605"; exon_assignment "SIRV605_5"; |
| SIRV6 | LexogenSIRVData | exon | 3107 | 3164 | . | + | 0 | gene_id "SIRV6"; transcript_id "SIRV605"; exon_assignment "SIRV605_6"; |
| SIRV6 | LexogenSIRVData | exon | 10725 | 10818 | . | + | 0 | gene_id "SIRV6"; transcript_id "SIRV605"; exon_assignment "SIRV605_7"; |
| SIRV6 | LexogenSIRVData | exon | 11032 | 11331 | . | + | 0 | gene_id "SIRV6"; transcript_id "SIRV605"; exon_assignment "SIRV605_8"; |
| SIRV6 | LexogenSIRVData | exon | 2286 | 2620 | . | + | 0 | gene_id "SIRV6"; transcript_id "SIRV606"; exon_assignment "SIRV606_0"; |
| SIRV6 | LexogenSIRVData | exon | 2741 | 2828 | . | + | 0 | gene_id "SIRV6"; transcript_id "SIRV606"; exon_assignment "SIRV606_1"; |
| SIRV6 | LexogenSIRVData | exon | 3107 | 3164 | . | + | 0 | gene_id "SIRV6"; transcript_id "SIRV606"; exon_assignment "SIRV606_2"; |
| SIRV6 | LexogenSIRVData | exon | 10725 | 10788 | . | + | 0 | gene_id "SIRV6"; transcript_id "SIRV606"; exon_assignment "SIRV606_3"; |
| SIRV6 | LexogenSIRVData | exon | 1131 | 1186 | . | + | 0 | gene_id "SIRV6"; transcript_id "SIRV607"; exon_assignment "SIRV607_0"; |
| SIRV6 | LexogenSIRVData | exon | 1469 | 1735 | . | + | 0 | gene_id "SIRV6"; transcript_id "SIRV607"; exon_assignment "SIRV607_1"; |
| SIRV6 | LexogenSIRVData | exon | 1846 | 2026 | . | + | 0 | gene_id "SIRV6"; transcript_id "SIRV607"; exon_assignment "SIRV607_2"; |
| SIRV6 | LexogenSIRVData | exon | 2471 | 2540 | . | + | 0 | gene_id "SIRV6"; transcript_id "SIRV607"; exon_assignment "SIRV607_3"; |
| SIRV6 | LexogenSIRVData | exon | 3024 | 3164 | . | + | 0 | gene_id "SIRV6"; transcript_id "SIRV608"; exon_assignment "SIRV608_0"; |
| SIRV6 | LexogenSIRVData | exon | 10725 | 10818 | . | + | 0 | gene_id "SIRV6"; transcript_id "SIRV608"; exon_assignment "SIRV608_1"; |
| SIRV6 | LexogenSIRVData | exon | 11032 | 11108 | . | + | 0 | gene_id "SIRV6"; transcript_id "SIRV608"; exon_assignment "SIRV608_2"; |
| SIRV6 | LexogenSIRVData | exon | 11206 | 11270 | . | + | 0 | gene_id "SIRV6"; transcript_id "SIRV608"; exon_assignment "SIRV608_3"; |
| SIRV6 | LexogenSIRVData | exon | 1138 | 1186 | . | + | 0 | gene_id "SIRV6"; transcript_id "SIRV609"; exon_assignment "SIRV609_0"; |
| SIRV6 | LexogenSIRVData | exon | 1469 | 1534 | . | + | 0 | gene_id "SIRV6"; transcript_id "SIRV609"; exon_assignment "SIRV609_1"; |
| SIRV6 | LexogenSIRVData | exon | 1641 | 1735 | . | + | 0 | gene_id "SIRV6"; transcript_id "SIRV609"; exon_assignment "SIRV609_2"; |
| SIRV6 | LexogenSIRVData | exon | 1846 | 2120 | . | + | 0 | gene_id "SIRV6"; transcript_id "SIRV609"; exon_assignment "SIRV609_3"; |
| SIRV6 | LexogenSIRVData | exon | 2473 | 2620 | . | + | 0 | gene_id "SIRV6"; transcript_id "SIRV610"; exon_assignment "SIRV610_0"; |
| SIRV6 | LexogenSIRVData | exon | 2741 | 2828 | . | + | 0 | gene_id "SIRV6"; transcript_id "SIRV610"; exon_assignment "SIRV610_1"; |
| SIRV6 | LexogenSIRVData | exon | 3107 | 3164 | . | + | 0 | gene_id "SIRV6"; transcript_id "SIRV610"; exon_assignment "SIRV610_2"; |
| SIRV6 | LexogenSIRVData | exon | 10725 | 11108 | . | + | 0 | gene_id "SIRV6"; transcript_id "SIRV610"; exon_assignment "SIRV610_3"; |
| SIRV6 | LexogenSIRVData | exon | 11206 | 11690 | . | + | 0 | gene_id "SIRV6"; transcript_id "SIRV610"; exon_assignment "SIRV610_4"; |
| SIRV6 | LexogenSIRVData | exon | 1304 | 1381 | . | + | 0 | gene_id "SIRV6"; transcript_id "SIRV611"; exon_assignment "SIRV611_0"; |
| SIRV6 | LexogenSIRVData | exon | 1469 | 1534 | . | + | 0 | gene_id "SIRV6"; transcript_id "SIRV611"; exon_assignment "SIRV611_1"; |
| SIRV6 | LexogenSIRVData | exon | 1641 | 1950 | . | + | 0 | gene_id "SIRV6"; transcript_id "SIRV611"; exon_assignment "SIRV611_2"; |
| SIRV6 | LexogenSIRVData | exon | 1088 | 1186 | . | + | 0 | gene_id "SIRV6"; transcript_id "SIRV612"; exon_assignment "SIRV612_0"; |
| SIRV6 | LexogenSIRVData | exon | 1469 | 1534 | . | + | 0 | gene_id "SIRV6"; transcript_id "SIRV612"; exon_assignment "SIRV612_1"; |
| SIRV6 | LexogenSIRVData | exon | 1641 | 1735 | . | + | 0 | gene_id "SIRV6"; transcript_id "SIRV612"; exon_assignment "SIRV612_2"; |
| SIRV6 | LexogenSIRVData | exon | 1846 | 2026 | . | + | 0 | gene_id "SIRV6"; transcript_id "SIRV612"; exon_assignment "SIRV612_3"; |
| SIRV6 | LexogenSIRVData | exon | 2471 | 2620 | . | + | 0 | gene_id "SIRV6"; transcript_id "SIRV612"; exon_assignment "SIRV612_4"; |
| SIRV6 | LexogenSIRVData | exon | 2741 | 2828 | . | + | 0 | gene_id "SIRV6"; transcript_id "SIRV612"; exon_assignment "SIRV612_5"; |

APPENDIX C-continued

GTF file SIRV O

| | | | | | | | |
|---|---|---|---|---|---|---|---|
| SIRV6 | LexogenSIRVData | exon | 3107 | 3164 | . | + | 0 gene_id "SIRV6"; transcript_id "SIRV612"; exon_assignment "SIRV612_6"; |
| SIRV6 | LexogenSIRVData | exon | 10725 | 10818 | . | + | 0 gene_id "SIRV6"; transcript_id "SIRV612"; exon_assignment "SIRV612_7"; |
| SIRV6 | LexogenSIRVData | exon | 11032 | 11108 | . | + | 0 gene_id "SIRV6"; transcript_id "SIRV612"; exon_assignment "SIRV612_8"; |
| SIRV6 | LexogenSIRVData | exon | 11206 | 11825 | . | + | 0 gene_id "SIRV6"; transcript_id "SIRV612"; exon_assignment "SIRV612_9"; |
| SIRV6 | LexogenSIRVData | exon | 3106 | 3164 | . | + | 0 gene_id "SIRV6"; transcript_id "SIRV613"; exon_assignment "SIRV613_0"; |
| SIRV6 | LexogenSIRVData | exon | 7105 | 7448 | . | + | 0 gene_id "SIRV6"; transcript_id "SIRV613"; exon_assignment "SIRV613_1"; |
| SIRV6 | LexogenSIRVData | exon | 7806 | 7923 | . | + | 0 gene_id "SIRV6"; transcript_id "SIRV613"; exon_assignment "SIRV613_2"; |
| SIRV6 | LexogenSIRVData | exon | 10725 | 10818 | . | + | 0 gene_id "SIRV6"; transcript_id "SIRV613"; exon_assignment "SIRV613_3"; |
| SIRV6 | LexogenSIRVData | exon | 11032 | 11108 | . | + | 0 gene_id "SIRV6"; transcript_id "SIRV613"; exon_assignment "SIRV613_4"; |
| SIRV6 | LexogenSIRVData | exon | 11206 | 11824 | . | + | 0 gene_id "SIRV6"; transcript_id "SIRV613"; exon_assignment "SIRV613_5"; |
| SIRV6 | LexogenSIRVData | exon | 2517 | 2620 | . | + | 0 gene_id "SIRV6"; transcript_id "SIRV614"; exon_assignment "SIRV614_0"; |
| SIRV6 | LexogenSIRVData | exon | 2741 | 2828 | . | + | 0 gene_id "SIRV6"; transcript_id "SIRV614"; exon_assignment "SIRV614_1"; |
| SIRV6 | LexogenSIRVData | exon | 3107 | 3164 | . | + | 0 gene_id "SIRV6"; transcript_id "SIRV614"; exon_assignment "SIRV614_2"; |
| SIRV6 | LexogenSIRVData | exon | 7806 | 7923 | . | + | 0 gene_id "SIRV6"; transcript_id "SIRV614"; exon_assignment "SIRV614_"3; |
| SIRV6 | LexogenSIRVData | exon | 10725 | 10815 | . | + | 0 gene_id "SIRV6"; transcript_id "SIRV614"; exon_assignment "SIRV614_4"; |
| SIRV6 | LexogenSIRVData | exon | 10238 | 10818 | . | + | 0 gene_id "SIRV6"; transcript_id "SIRV615"; exon_assignment "SIRV615_0"; |
| SIRV6 | LexogenSIRVData | exon | 11032 | 11108 | . | + | 0 gene_id "SIRV6"; transcript_id "SIRV615"; exon_assignment "SIRV615_1"; |
| SIRV6 | LexogenSIRVData | exon | 11206 | 11330 | . | + | 0 gene_id "SIRV6"; transcript_id "SIRV615"; exon_assignment "SIRV615_2"; |
| SIRV6 | LexogenSIRVData | exon | 2286 | 2620 | . | + | 0 gene_id "SIRV6"; transcript_id "SIRV616"; exon_assignment "SIRV616_0"; |
| SIRV6 | LexogenSIRVData | exon | 2741 | 2814 | . | + | 0 gene_id "SIRV6"; transcript_id "SIRV616"; exon_assignment "SIRV616_1"; |
| SIRV6 | LexogenSIRVData | exon | 3107 | 3164 | . | + | 0 gene_id "SIRV6"; transcript_id "SIRV616"; exon_assignment "SIRV616_2"; |
| SIRV6 | LexogenSIRVData | exon | 10725 | 10788 | . | + | 0 gene_id "SIRV6"; transcript_id "SIRV616"; exon_assignment "SIRV616_3"; |
| SIRV6 | LexogenSIRVData | exon | 1545 | 1820 | . | − | 0 gene_id "SIRV6"; transcript_id "SIRV617"; exon_assignment "SIRV617_0"; |
| SIRV6 | LexogenSIRVData | exon | 2359 | 2547 | . | − | 0 gene_id "SIRV6"; transcript_id "SIRV618"; exon_assignment "SIRV618_0"; |
| SIRV6 | LexogenSIRVData | exon | 1125 | 1186 | . | + | 0 gene_id "SIRV6"; transcript_id "SIRV619"; exon_assignment "SIRV619_0"; |
| SIRV6 | LexogenSIRVData | exon | 1304 | 1381 | . | + | 0 gene_id "SIRV6"; transcript_id "SIRV619"; exon_assignment "SIRV619_1"; |
| SIRV6 | LexogenSIRVData | exon | 1469 | 2120 | . | + | 0 gene_id "SIRV6"; transcript_id "SIRV619"; exon_assignment "SIRV619_2"; |
| SIRV6 | LexogenSIRVData | exon | 2286 | 2620 | . | + | 0 gene_id "SIRV6"; transcript_id "SIRV619"; exon_assignment "SIRV619_3"; |
| SIRV6 | LexogenSIRVData | exon | 2741 | 2828 | . | + | 0 gene_id "SIRV6"; transcript_id "SIRV619"; exon_assignment "SIRV619_4"; |
| SIRV6 | LexogenSIRVData | exon | 3024 | 3164 | . | + | 0 gene_id "SIRV6"; transcript_id "SIRV619"; exon_assignment "SIRV619_5"; |
| SIRV6 | LexogenSIRVData | exon | 7105 | 7448 | . | + | 0 gene_id "SIRV6"; transcript_id "SIRV619"; exon_assignment "SIRV619_6"; |
| SIRV6 | LexogenSIRVData | exon | 7806 | 7923 | . | + | 0 gene_id "SIRV6"; transcript_id "SIRV619"; exon_assignment "SIRV619_7"; |
| SIRV6 | LexogenSIRVData | exon | 9000 | 11825 | . | + | 0 gene_id "SIRV6"; transcript_id "SIRV619"; exon_assignment "SIRV619_8"; |
| SIRV6 | LexogenSIRVData | exon | 9000 | 10818 | . | + | 0 gene_id "SIRV6"; transcript_id "SIRV620"; exon_assignment "SIRV620_0"; |
| SIRV6 | LexogenSIRVData | exon | 11206 | 11837 | . | + | 0 gene_id "SIRV6"; transcript_id "SIRV620"; exon_assignment "SIRV620_1"; |
| SIRV6 | LexogenSIRVData | exon | 1001 | 1186 | . | + | 0 gene_id "SIRV6"; transcript_id "SIRV621"; exon_assignment "SIRV621_0"; |
| SIRV6 | LexogenSIRVData | exon | 1304 | 1381 | . | + | 0 gene_id "SIRV6"; transcript_id "SIRV621"; exon_assignment "SIRV621_1"; |
| SIRV6 | LexogenSIRVData | exon | 1469 | 2120 | . | + | 0 gene_id "SIRV6"; transcript_id "SIRV621"; exon_assignment "SIRV621_2"; |
| SIRV6 | LexogenSIRVData | exon | 2286 | 2620 | . | + | 0 gene_id "SIRV6"; transcript_id "SIRV621"; exon_assignment "SIRV621_3"; |
| SIRV6 | LexogenSIRVData | exon | 2741 | 2814 | . | + | 0 gene_id "SIRV6"; transcript_id "SIRV621"; exon_assignment "SIRV621_4"; |
| SIRV6 | LexogenSIRVData | exon | 3024 | 3164 | . | + | 0 gene_id "SIRV6"; transcript_id "SIRV621"; exon_assignment "SIRV621_5"; |
| SIRV6 | LexogenSIRVData | exon | 7105 | 7448 | . | + | 0 gene_id "SIRV6"; transcript_id "SIRV621"; exon_assignment "SIRV621_6"; |
| SIRV6 | LexogenSIRVData | exon | 7806 | 7923 | . | + | 0 gene_id "SIRV6"; transcript_id "SIRV621"; exon_assignment "SIRV621_7"; |
| SIRV6 | LexogenSIRVData | exon | 10725 | 10818 | . | + | 0 gene_id "SIRV6"; transcript_id "SIRV621"; exon_assignment "SIRV621_8"; |
| SIRV6 | LexogenSIRVData | exon | 11032 | 11108 | . | + | 0 gene_id "SIRV6"; transcript_id "SIRV621"; exon_assignment "SIRV621_9"; |
| SIRV6 | LexogenSIRVData | exon | 11206 | 11825 | . | + | 0 gene_id "SIRV6"; transcript_id "SIRV621"; exon_assignment "SIRV621_10"; |
| SIRV6 | LexogenSIRVData | exon | 1088 | 1186 | . | + | 0 gene_id "SIRV6"; transcript_id "SIRV622"; exon_assignment "SIRV622_0"; |
| SIRV6 | LexogenSIRVData | exon | 1469 | 1534 | . | + | 0 gene_id "SIRV6"; transcript_id "SIRV622"; exon_assignment "SIRV622_1"; |
| SIRV6 | LexogenSIRVData | exon | 1641 | 1735 | . | + | 0 gene_id "SIRV6"; transcript_id "SIRV622"; exon_assignment "SIRV622_2"; |
| SIRV6 | LexogenSIRVData | exon | 1846 | 2026 | . | + | 0 gene_id "SIRV6"; transcript_id "SIRV622"; exon_assignment "SIRV622_3"; |
| SIRV6 | LexogenSIRVData | exon | 2471 | 2620 | . | + | 0 gene_id "SIRV6"; transcript_id "SIRV622"; exon_assignment "SIRV622_4"; |
| SIRV6 | LexogenSIRVData | exon | 2741 | 2828 | . | + | 0 gene_id "SIRV6"; transcript_id "SIRV622"; exon_assignment "SIRV622_5"; |
| SIRV6 | LexogenSIRVData | exon | 3107 | 3164 | . | + | 0 gene_id "SIRV6"; transcript_id "SIRV622"; exon_assignment "SIRV622_6"; |
| SIRV6 | LexogenSIRVData | exon | 10725 | 10818 | . | + | 0 gene_id "SIRV6"; transcript_id "SIRV622"; exon_assignment "SIRV622_7"; |
| SIRV6 | LexogenSIRVData | exon | 11032 | 11108 | . | + | 0 gene_id "SIRV6"; transcript_id "SIRV622"; exon_assignment "SIRV622_8"; |
| SIRV6 | LexogenSIRVData | exon | 11206 | 11330 | . | + | 0 gene_id "SIRV6"; transcript_id "SIRV622"; exon_assignment "SIRV622_9"; |
| SIRV6 | LexogenSIRVData | exon | 3106 | 3164 | . | + | 0 gene_id "SIRV6"; transcript_id "SIRV623"; exon_assignment "SIRV623_0"; |
| SIRV6 | LexogenSIRVData | exon | 7105 | 7448 | . | + | 0 gene_id "SIRV6"; transcript_id "SIRV623"; exon_assignment "SIRV623_1"; |
| SIRV6 | LexogenSIRVData | exon | 7806 | 7923 | . | + | 0 gene_id "SIRV6"; transcript_id "SIRV623"; exon_assignment "SIRV623_2"; |
| SIRV6 | LexogenSIRVData | exon | 10725 | 10818 | . | + | 0 gene_id "SIRV6"; transcript_id "SIRV623"; exon_assignment "SIRV623_3"; |
| SIRV6 | LexogenSIRVData | exon | 11032 | 11108 | . | + | 0 gene_id "SIRV6"; transcript_id "SIRV623"; exon_assignment "SIRV623_4"; |
| SIRV6 | LexogenSIRVData | exon | 11206 | 11270 | . | + | 0 gene_id "SIRV6"; transcript_id "SIRV623"; exon_assignment "SIRV623_5"; |
| SIRV6 | LexogenSIRVData | exon | 3106 | 3164 | . | + | 0 gene_id "SIRV6"; transcript_id "SIRV624"; exon_assignment "SIRV624_0"; |
| SIRV6 | LexogenSIRVData | exon | 7105 | 7448 | . | + | 0 gene_id "SIRV6"; transcript_id "SIRV624"; exon_assignment "SIRV624_1"; |
| SIRV6 | LexogenSIRVData | exon | 7806 | 7923 | . | + | 0 gene_id "SIRV6"; transcript_id "SIRV624"; exon_assignment "SIRV624_2"; |
| SIRV6 | LexogenSIRVData | exon | 10725 | 10818 | . | + | 0 gene_id "SIRV6"; transcript_id "SIRV624"; exon_assignment "SIRV624_3"; |
| SIRV6 | LexogenSIRVData | exon | 11032 | 11330 | . | + | 0 gene_id "SIRV6"; transcript_id "SIRV624"; exon_assignment "SIRV624_4"; |
| SIRV6 | LexogenSIRVData | exon | 2473 | 2620 | . | + | 0 gene_id "SIRV6"; transcript_id "SIRV625"; exon_assignment "SIRV625_0"; |
| SIRV6 | LexogenSIRVData | exon | 2741 | 2828 | . | + | 0 gene_id "SIRV6"; transcript_id "SIRV625"; exon_assignment "SIRV625_1"; |
| SIRV6 | LexogenSIRVData | exon | 3107 | 3164 | . | + | 0 gene_id "SIRV6"; transcript_id "SIRV625"; exon_assignment "SIRV625_2"; |
| SIRV6 | LexogenSIRVData | exon | 10725 | 10818 | . | + | 0 gene_id "SIRV6"; transcript_id "SIRV625"; exon_assignment "SIRV625_3"; |
| SIRV6 | LexogenSIRVData | exon | 11032 | 11108 | . | + | 0 gene_id "SIRV6"; transcript_id "SIRV625"; exon_assignment "SIRV625_4"; |
| SIRV6 | LexogenSIRVData | exon | 11206 | 11826 | . | + | 0 gene_id "SIRV6"; transcript_id "SIRV625"; exon_assignment "SIRV625_5"; |
| SIRV7 | LexogenSIRVData | exon | 1004 | 2675 | . | − | 0 gene_id "SIRV7"; transcript_id "SIRV701"; exon_assignment "SIRV701_0"; |
| SIRV7 | LexogenSIRVData | exon | 2994 | 3111 | . | − | 0 gene_id "SIRV7"; transcript_id "SIRV701"; exon_assignment "SIRV701_1"; |
| SIRV7 | LexogenSIRVData | exon | 43029 | 43077 | . | − | 0 gene_id "SIRV7"; transcript_id "SIRV701"; exon_assignment "SIRV701_2"; |
| SIRV7 | LexogenSIRVData | exon | 114681 | 114988 | . | − | 0 gene_id "SIRV7"; transcript_id "SIRV701"; exon_assignment "SIRV701_3"; |
| SIRV7 | LexogenSIRVData | exon | 147609 | 147923 | . | − | 0 gene_id "SIRV7"; transcript_id "SIRV701"; exon_assignment "SIRV701_4"; |

APPENDIX C-continued

GTF file SIRV O

| | | | | | | | | |
|---|---|---|---|---|---|---|---|---|
| SIRV7 | LexogenSIRVData | exon | 1001 | 2675 | . | − | 0 | gene_id "SIRV7"; transcript_id "SIRV702"; exon_assignment "SIRV702_0"; |
| SIRV7 | LexogenSIRVData | exon | 2994 | 3111 | . | − | 0 | gene_id "SIRV7"; transcript_id "SIRV702"; exon_assignment "SIRV702_1"; |
| SIRV7 | LexogenSIRVData | exon | 4096 | 4179 | . | − | 0 | gene_id "SIRV7"; transcript_id "SIRV702"; exon_assignment "SIRV702_2"; |
| SIRV7 | LexogenSIRVData | exon | 4726 | 4810 | . | − | 0 | gene_id "SIRV7"; transcript_id "SIRV702"; exon_assignment "SIRV702_3"; |
| SIRV7 | LexogenSIRVData | exon | 43029 | 43077 | . | − | 0 | gene_id "SIRV7"; transcript_id "SIRV702"; exon_assignment "SIRV702_4"; |
| SIRV7 | LexogenSIRVData | exon | 114681 | 114916 | . | − | 0 | gene_id "SIRV7"; transcript_id "SIRV702"; exon_assignment "SIRV702_5"; |
| SIRV7 | LexogenSIRVData | exon | 1001 | 2675 | . | − | 0 | gene_id "SIRV7"; transcript_id "SIRV703"; exon_assignment "SIRV703_0"; |
| SIRV7 | LexogenSIRVData | exon | 2994 | 3111 | . | − | 0 | gene_id "SIRV7"; transcript_id "SIRV703"; exon_assignment "SIRV703_1"; |
| SIRV7 | LexogenSIRVData | exon | 3810 | 3896 | . | − | 0 | gene_id "SIRV7"; transcript_id "SIRV703"; exon_assignment "SIRV703_2"; |
| SIRV7 | LexogenSIRVData | exon | 114681 | 114988 | . | − | 0 | gene_id "SIRV7"; transcript_id "SIRV703"; exon_assignment "SIRV703_3"; |
| SIRV7 | LexogenSIRVData | exon | 147609 | 147918 | . | − | 0 | gene_id "SIRV7"; transcript_id "SIRV703"; exon_assignment "SIRV703_4"; |
| SIRV7 | LexogenSIRVData | exon | 55850 | 56097 | . | − | 0 | gene_id "SIRV7"; transcript_id "SIRV704"; exon_assignment "SIRV704_0"; |
| SIRV7 | LexogenSIRVData | exon | 78842 | 78963 | . | − | 0 | gene_id "SIRV7"; transcript_id "SIRV704"; exon_assignment "SIRV704_1"; |
| SIRV7 | LexogenSIRVData | exon | 114681 | 114738 | . | − | 0 | gene_id "SIRV7"; transcript_id "SIRV704"; exon_assignment "SIRV704_2"; |
| SIRV7 | LexogenSIRVData | exon | 1006 | 2675 | . | − | 0 | gene_id "SIRV7"; transcript_id "SIRV705"; exon_assignment "SIRV705_0"; |
| SIRV7 | LexogenSIRVData | exon | 2994 | 3111 | . | − | 0 | gene_id "SIRV7"; transcript_id "SIRV705"; exon_assignment "SIRV705_1"; |
| SIRV7 | LexogenSIRVData | exon | 43029 | 43077 | . | − | 0 | gene_id "SIRV7"; transcript_id "SIRV705"; exon_assignment "SIRV705_2"; |
| SIRV7 | LexogenSIRVData | exon | 114681 | 114988 | . | − | 0 | gene_id "SIRV7"; transcript_id "SIRV705"; exon_assignment "SIRV705_3"; |
| SIRV7 | LexogenSIRVData | exon | 147609 | 147925 | . | − | 0 | gene_id "SIRV7"; transcript_id "SIRV705"; exon_assignment "SIRV705_4"; |
| SIRV7 | LexogenSIRVData | exon | 56032 | 56097 | . | − | 0 | gene_id "SIRV7"; transcript_id "SIRV706"; exon_assignment "SIRV706_0"; |
| SIRV7 | LexogenSIRVData | exon | 70884 | 70987 | . | − | 0 | gene_id "SIRV7"; transcript_id "SIRV706"; exon_assignment "SIRV706_1"; |
| SIRV7 | LexogenSIRVData | exon | 78842 | 78963 | . | − | 0 | gene_id "SIRV7"; transcript_id "SIRV706"; exon_assignment "SIRV706_2"; |
| SIRV7 | LexogenSIRVData | exon | 114681 | 114988 | . | − | 0 | gene_id "SIRV7"; transcript_id "SIRV706"; exon_assignment "SIRV706_3"; |
| SIRV7 | LexogenSIRVData | exon | 147609 | 147957 | . | − | 0 | gene_id "SIRV7"; transcript_id "SIRV706"; exon_assignment "SIRV706_4"; |
| SIRV7 | LexogenSIRVData | exon | 56038 | 56097 | . | − | 0 | gene_id "SIRV7"; transcript_id "SIRV708"; exon_assignment "SIRV708_0"; |
| SIRV7 | LexogenSIRVData | exon | 70884 | 70987 | . | − | 0 | gene_id "SIRV7"; transcript_id "SIRV708"; exon_assignment "SIRV708_1"; |
| SIRV7 | LexogenSIRVData | exon | 78842 | 78908 | . | − | 0 | gene_id "SIRV7"; transcript_id "SIRV708"; exon_assignment "SIRV708_2"; |
| SIRV7 | LexogenSIRVData | exon | 78929 | 78963 | . | − | 0 | gene_id "SIRV7"; transcript_id "SIRV708"; exon_assignment "SIRV708_3"; |
| SIRV7 | LexogenSIRVData | exon | 114687 | 114960 | . | − | 0 | gene_id "SIRV7"; transcript_id "SIRV708"; exon_assignment "SIRV708_4"; |
| SIRV7 | LexogenSIRVData | exon | 147609 | 147957 | . | − | 0 | gene_id "SIRV7"; transcript_id "SIRV708"; exon_assignment "SIRV708_5"; |
| SIRV7 | LexogenSIRVData | exon | 1417 | 2675 | . | − | 0 | gene_id "SIRV7"; transcript_id "SIRV707"; exon_assignment "SIRV707_0"; |
| SIRV7 | LexogenSIRVData | exon | 2994 | 3111 | . | − | 0 | gene_id "SIRV7"; transcript_id "SIRV707"; exon_assignment "SIRV707_1"; |
| SIRV7 | LexogenSIRVData | exon | 3810 | 3896 | . | − | 0 | gene_id "SIRV7"; transcript_id "SIRV707"; exon_assignment "SIRV707_2"; |
| SIRV7 | LexogenSIRVData | exon | 4096 | 4179 | . | − | 0 | gene_id "SIRV7"; transcript_id "SIRV707"; exon_assignment "SIRV707_3"; |
| SIRV7 | LexogenSIRVData | exon | 4726 | 4810 | . | − | 0 | gene_id "SIRV7"; transcript_id "SIRV707"; exon_assignment "SIRV707_4"; |
| SIRV7 | LexogenSIRVData | exon | 5035 | 5117 | . | − | 0 | gene_id "SIRV7"; transcript_id "SIRV707"; exon_assignment "SIRV707_5"; |
| SIRV7 | LexogenSIRVData | exon | 12420 | 12566 | . | − | 0 | gene_id "SIRV7"; transcript_id "SIRV707"; exon_assignment "SIRV707_6"; |
| SIRV7 | LexogenSIRVData | exon | 43029 | 43077 | . | − | 0 | gene_id "SIRV7"; transcript_id "SIRV707"; exon_assignment "SIRV707_7"; |
| SIRV7 | LexogenSIRVData | exon | 78842 | 78963 | . | − | 0 | gene_id "SIRV7"; transcript_id "SIRV707"; exon_assignment "SIRV707_8"; |
| SIRV7 | LexogenSIRVData | exon | 147609 | 147900 | . | − | 0 | gene_id "SIRV7"; transcript_id "SIRV707"; exon_assignment "SIRV707_9"; |
| SIRV7 | LexogenSIRVData | exon | 1001 | 2675 | . | − | 0 | gene_id "SIRV7"; transcript_id "SIRV709"; exon_assignment "SIRV709_0"; |
| SIRV7 | LexogenSIRVData | exon | 2994 | 3111 | . | − | 0 | gene_id "SIRV7"; transcript_id "SIRV709"; exon_assignment "SIRV709_1"; |
| SIRV7 | LexogenSIRVData | exon | 3810 | 3896 | . | − | 0 | gene_id "SIRV7"; transcript_id "SIRV709"; exon_assignment "SIRV709_2"; |
| SIRV7 | LexogenSIRVData | exon | 4096 | 4179 | . | − | 0 | gene_id "SIRV7"; transcript_id "SIRV709"; exon_assignment "SIRV709_3"; |
| SIRV7 | LexogenSIRVData | exon | 4726 | 4810 | . | − | 0 | gene_id "SIRV7"; transcript_id "SIRV709"; exon_assignment "SIRV709_4"; |
| SIRV7 | LexogenSIRVData | exon | 5035 | 5117 | . | − | 0 | gene_id "SIRV7"; transcript_id "SIRV709"; exon_assignment "SIRV709_5"; |
| SIRV7 | LexogenSIRVData | exon | 12420 | 12566 | . | − | 0 | gene_id "SIRV7"; transcript_id "SIRV709"; exon_assignment "SIRV709_6"; |
| SIRV7 | LexogenSIRVData | exon | 43029 | 43077 | . | − | 0 | gene_id "SIRV7"; transcript_id "SIRV709"; exon_assignment "SIRV709_7"; |
| SIRV7 | LexogenSIRVData | exon | 55850 | 56097 | . | − | 0 | gene_id "SIRV7"; transcript_id "SIRV709"; exon_assignment "SIRV709_8"; |
| SIRV7 | LexogenSIRVData | exon | 70884 | 70987 | . | − | 0 | gene_id "SIRV7"; transcript_id "SIRV709"; exon_assignment "SIRV709_9"; |
| SIRV7 | LexogenSIRVData | exon | 78842 | 78963 | . | − | 0 | gene_id "SIRV7"; transcript_id "SIRV709"; exon_assignment "SIRV709_10"; |
| SIRV7 | LexogenSIRVData | exon | 114681 | 114738 | . | − | 0 | gene_id "SIRV7"; transcript_id "SIRV709"; exon_assignment "SIRV709_11"; |
| SIRV7 | LexogenSIRVData | exon | 1004 | 2675 | . | − | 0 | gene_id "SIRV7"; transcript_id "SIRV710"; exon_assignment "SIRV710_0"; |
| SIRV7 | LexogenSIRVData | exon | 2994 | 3111 | . | − | 0 | gene_id "SIRV7"; transcript_id "SIRV710"; exon_assignment "SIRV710_1"; |
| SIRV7 | LexogenSIRVData | exon | 4096 | 4179 | . | − | 0 | gene_id "SIRV7"; transcript_id "SIRV710"; exon_assignment "SIRV710_2"; |
| SIRV7 | LexogenSIRVData | exon | 4726 | 4810 | . | − | 0 | gene_id "SIRV7"; transcript_id "SIRV710"; exon_assignment "SIRV710_3"; |
| SIRV7 | LexogenSIRVData | exon | 43029 | 43077 | . | − | 0 | gene_id "SIRV7"; transcript_id "SIRV710"; exon_assignment "SIRV710_4"; |
| SIRV7 | LexogenSIRVData | exon | 55850 | 56097 | . | − | 0 | gene_id "SIRV7"; transcript_id "SIRV710"; exon_assignment "SIRV710_5"; |
| SIRV7 | LexogenSIRVData | exon | 70884 | 70987 | . | − | 0 | gene_id "SIRV7"; transcript_id "SIRV710"; exon_assignment "SIRV710_6"; |
| SIRV7 | LexogenSIRVData | exon | 78842 | 78963 | . | − | 0 | gene_id "SIRV7"; transcript_id "SIRV710"; exon_assignment "SIRV710_7"; |
| SIRV7 | LexogenSIRVData | exon | 114681 | 114738 | . | − | 0 | gene_id "SIRV7"; transcript_id "SIRV710"; exon_assignment "SIRV710_8"; |
| SIRV7 | LexogenSIRVData | exon | 55850 | 56097 | . | − | 0 | gene_id "SIRV7"; transcript_id "SIRV711"; exon_assignment "SIRV711_0"; |
| SIRV7 | LexogenSIRVData | exon | 70884 | 70987 | . | − | 0 | gene_id "SIRV7"; transcript_id "SIRV711"; exon_assignment "SIRV711_1"; |
| SIRV7 | LexogenSIRVData | exon | 78842 | 78963 | . | − | 0 | gene_id "SIRV7"; transcript_id "SIRV711"; exon_assignment "SIRV711_2"; |
| SIRV7 | LexogenSIRVData | exon | 114681 | 114988 | . | − | 0 | gene_id "SIRV7"; transcript_id "SIRV711"; exon_assignment "SIRV711_3"; |
| SIRV7 | LexogenSIRVData | exon | 147609 | 147925 | . | − | 0 | gene_id "SIRV7"; transcript_id "SIRV711"; exon_assignment "SIRV711_4"; |

SEQUENCE LISTING (345 sequences)

SEQ ID NO: 1 - DNA, 1591 bp, Artificial Sequence
  transcript variant
gcttgtccgcgagtgtcaaccgggttttacaaaggagaacttccaacatcagtgtatgggatgtttcaaacacccccagagacggagacaatagtgtggtcacgtacatttaggaagataaaaataacaacaacagaaggtgtgaggcgcaaggtacatgctcttaccccactctcagcacgtagggagcggagtgtggaagaccaacaagcccgtcgcctctaccaaatacagctatcctgaggtgccaggttagaataggccctaccacatctaagccttgaaacggtctgttcctcgtgtcaagttctttgtccgcttataccgccatctctcgttgtggtacaagagttggttactctcagtcccattcccaacacatcactgagaagtatagagcctagtggtcattagaaggtcaacatggagtaggtgtttaggtgtgtcggagggcagaaaccaacgaaagaaaggaaacgatcaacacttatatagtgtcctgtcgggcccaaatcctaagagaccttaggtttaccacattagtactaaacagcctgttgtataccgtgagcccccacttcgatctgtaaatggtaatcccttgtaaaacctcatctccaaaaacagtatacgcaggtacagctgatgtgatcctctctactagtcttctctgaggaaccatgagatggatagtgggggacctgagtcatactagggtaacttcttatatggtgacatcactcctaccgtagaggggggacggtagtctgtgggaaatctaccctagtgaagaaaggtaagagaatgtctgaacattacctgtagacgaaggtactctcagaacaactactctcacatacggaaaggtttgggtccttggtcaaaggactttactgactctgcagacgatgaatatctgaaccaacactactatcaaagatgttcgactagacctctcgtggtagggcctggaagtcaaaagacttctctatgggtactaggtaggtagttagagtacggtccctggggtgtctcagagtcgaacgttcgggggaagttcctaaacatgttaggatgttatgataacaagtccaaacgtggacgtcgtcgctgtcacctctcggaacactagctgaggtggcttaaaaacattccgtaactgagtggtcaccgggggtgaaacatgctgagggttctaccttaacgggaaggtgaaactctccaatgtctttgaaaggactagttgagataacccaaaccgaatccggaggaagaggagaacttggaaaacgttgtacgacgtcattaataacgattccgttcttcccgttcgtgtctataaggatattctttcattgcgaaggtaagcccttttgggtctagatacggactatactcaaaaacccacagaccttccacttggagttgttttaggagacggagtagtagagaaaacttgtggcaccttcccagtcggttccctacagactctccttagtagctcctaagatcgtcgagttacacgacgacattgttccgactgacgtagaggcattactttaaaaaaaaaaaaaaaaaaaaaaaaaaaaaa

SEQ ID NO: 2 - DNA, 1330 bp, Artificial Sequence
  transcript variant
gtacaagagttggttactctcagtcccattcccaacacatcactgagaagtatagagcctagtggtcattagaaggtcaacatggagtaggtgtttaggtgtgtcggagggcagaaaccaacgaaagaaaggaaacgatcaacacttatatagtgtcctgtcgggcccaaatcctaagagaccttaggtttaccacattagtactaaacagcctgttgtataccgtgagcccccacttcgatctgtaaatggtaatcccttgtaaaacctcatctccaaaaacagtatacgcaggtacagctgatgtgatcctctctactagtcttctctgaggaaccatgagatggatagtgggggacctgagtcatactagggtaacttcttatatggtgacatcactcctaccgtagaggggggacggtagtctgtgggaaatctaccctagtgaagaaaggtaagagaatgtctgaacattacctgtagacgaaggtactctcagaacaactactctcacatacggaaaggtttgggtccttggtcaaaggactttactgactctgcagacgatgaatatctgaaccaacactactatcaaagatgtcgtaggtttgtgagaagggagaagaagtggttgagaagttggtgttccacaagttaaagtagacatacctttagtacctgtaaaggttcgactagacctctcgtggtagggcctggaagtcaaaagacttctctatgggtactaggtaggtagttagagtacggtccctggggtgtctcagagtcgaacgttcgggggaagttcctaaacatgttaggatgttatgataacaagtccaaacgtggacgtcgtcgctgtcacctctcggaacactagctgaggtggcttaaaaacattccgtaactgagtggtcaccgggggtgaaacatgctgagggttctaccttaacgggaaggtgaaactctccaatgtctttgaaaggactagttgagataacccaaaccgaatccggaggaagaggagaacttggaaaacgttgtacgacgtcattaataacgattccgttcttcccgttcgtgtctataaggatattctttcattgcgaaggtaagcccttttgggtctagatacggactatactcaaaaacccacagaccttccacttggagttgttttaggagacggagtagtagagaaaacttgtggcaccttcccagtcggttccctacagactctccttagtagctcctaagatcgtcgagttacacgacgacattgttccgactgacgtagaggcataaaaaaaaaaaaaaaaaaaaaaaaaaaaaa

SEQ ID NO: 3 - DNA, 1393 bp, Artificial Sequence
  transcript variant
gtgaggcttgtccgcgagtgtcaaccgggttttacaaaggagaacttccaacatcagtgtatgggatgtttcaaacacccccagagacggagacaatagtgtggtcacgtacatttaggaagataaaaataacaacaacagaaggtacaagagttggttactctcagtcccattcccaacacatcactgagaagtatagagcctagtggtcattagaaggtcaacatggagtaggtgtttaggtgtgtcggagggcagaaaccaacgaaagaaaggaaacgatcaacacttatatagtgtcctgtcgggcccaaatcctaagagaccttaggtttaccacattagtactaaacagcctgttgtataccgtgagcccccacttcgatctgtaaatggtaatcccttgtaaaacctcatctccaaaaacagtatacgcaggtacagctgatgtgatcctctctactagtcttctctgaggaaccatgagatggatagtgggggacctgagtcatactagggtaacttcttatatggtgacatcactcctaccgtagaggggggacggtagtctgtgggaaatctaccctagtgaagaaaggtaagagaatgtctgaacattacctgtagacgaaggtactctcagaacaactactctcacatacggaaaggtttgggtccttggtcaaaggactttactgactctgcagacgatgaatatctgaaccaacactactatcaaagatgttcgactagacctctcgtggtagggcctggaagtcaaaagacttctctatgggtactaggtaggtagttagagtacggtccctggggtgtctcagagtcgaacgttcgggggaagttcctaaacatgttaggatgttatgataacaagtccaaacgtggacgtcgtcgctgtcacctctcggaacactagctgaggtggcttaaaaacattccgtaactgagtggtcaccgggggtgaaacatgctgagggttctaccttaacgggaaggtgaaactctccaatgtctttgaaaggactagttgagataacccaaaccgaatccggaggaagaggagaacttggaaaacgttgtacgacgtcattaataacgattccgttcttcccgttcgtgtctataaggatattctttcattgcgaaggtaagcccttttgggtctagatacggactatactcaaaaacccacagaccttccacttggagttgttttaggagacggagtagtagagaaaacttgtggcaccttcccagtcggttccctacagactctccttagtagctcctaagatcgtcgagttacacgacgacattgttccgactgacgtagaggcattactttaaaaaaaaaaaaaaaaaaaaaaaaaaaaaa

SEQ ID NO: 4 - DNA, 1429 bp, Artificial Sequence
  transcript variant
gttttacaaaggagaacttccaacatcagtgtatgggatgtttcaaacacccccagagacggagacaatagtgtggtcacgtacatttaggaagataaaaataacaacaacagaagccttgaaacggtctgttcctcgtgtcaagttctttgtccgcttataccgccatctctcgttgtggtacaagagttggttactctcagtcccattcccaacacatcactgagaagtatagagcctagtggtcattagaaggtcaacatggagtaggtgtttaggtgtgtcggagggcagaaaccaacgaaagaaaggaaacgatcaacacttatatagtgtcctgtcgggcccaaatcctaagagaccttaggtttaccacattagtactaaacagcctgttgtataccgtgagcccccacttcgatctgtaaatggtaatcccttgtaaaacctcatctccaaaaacagtatacgcaggtacagctgatgtgatcctctctactagtcttctctgaggaaccatgagatggatagtgggggacctgagtcatactagggtaacttcttatatggtgacatcactcctaccgtagaggggggacggtagtctgtgggaaatctaccctagtgaagaaaggtaagagaatgtctgaacattacctgtagacgaaggtactctcagaacaactactctcacatacggaaaggtttgggtccttggtcaaaggactttactgactctgcagacgatgaatatctgaaccaacactactatcaaagatgttcgactagacctctcgtggtagggcctggaagtcaaaagacttctctatgggtactaggtaggtagttagagtacggtccctggggtgtctcagagtcgaacgttcgggggaagttcctaaacatgttaggatgttatgataacaagtccaaacgtggacgtcgtcgctgtcacctctcggaacactagctgaggtggcttaaaaacattccgtaactgagtggtcaccgggggtgaaacatgctgagggttctaccttaacgggaaggtgaaactctccaatgtctttgaaaggactagttgagataacccaaaccgaatccggaggaagaggagaacttggaaaacgttgtacgacgtcattaataacgattccgttcttcccgttcgtgtctataaggatattctttcattgcgaaggtaagcccttttgggtctagatacggactatactcaaaaacccacagaccttccacttggagttgttttaggagacggagtagtagagaaaacttgtggcaccttcccagtcggttccctacagactctccttagtagctcctaagatcgtcgagttacacgacgacattgttccgactgacgtagaggcattactttaaaaaaaaaaaaaaaaaaaaaaaaaaaaaa

SEQ ID NO: 5 - DNA, 700 bp, Artificial Sequence
  transcript variant
gcgcaaggtacatgctcttaccccactctcagcacgtagggagcggagtacaagagttggttactctcagtcccattcccaacacatcactgagaagtatagagcctagtggtcattagaaggtcaacatggagtaggtgtttaggtgtgtcggagggcagaaaccaacgaaagaaaggaaacgatcaacacttatatagtgtcctgtcgggcccaaatcctaagagaccttaggtttaccacattagtactaaacagcctgttgtataccgtgagcccccacttcgatctgtaaatggtaatcccttgtaaaacctcatctccaaaaacagtatacgcaggtacagctgatgtgatcctctctactagtcttctctgaggaaccatgagatggatagtgggggacctgagtcatactagggtaacttcttatatggtgacatcactcctaccgtagaggggggacggtagtctgtgggaaatctaccctagtgaagaaaggtaagagaatgtctgaacattacctgtagacgaaggtactctcagaacaactactctcacatacggaaaggtttgggtccttggtcaaaggactttactgactctgcagacgatgaatatctgaaccaacactactatcaaagatgttcgactagacctctcgtggtagaaaaaaaaaaaaaaaaaaaaaaaaaaaaaa

SEQ ID NO: 6 - DNA, 1003 bp, Artificial Sequence
  transcript variant
gcttgtccgcgagtgtcaaccgggttttacaaaggagaacttccaacatcagtgtatgggatgtttcaaacacccccagagacggagacaatagtgtggtcacgtacatttaggaagataaaaataacaacaacagaaggtgtgaggcgcaaggtacatgctcttaccccactctcagcacgtagggagcggagtgtggaagaccaacaagcccgtcgcctctaccaaatacagtgtttaggtgtgtcggagggcagaaaccaacgaaagaaaggaaacgatcaacacttatatagtgtcctgtcgggcccaaatcctaagagaccttaggtttaccacattagtactaaacagcctgttgtataccgtgagcccccacttcgatctgtaaatggtaatcccttgtaaaacctcatctccaaaaacagtatacgcaggtacagctgatgtgatcctctctactagtcttctctgaggaaccatgagatgttatgataacaagtccaaacgtggacgtcgtcgctgtcacctctcggaacactagctgaggtggcttaaaaacattccgtaactgagtggtcaccgggggtgaaacatgctgagggttctaccttaacgggaaggtgaaactctccaatgtctttgaaaggactagttgagataacccaaaccgaatccggaggaagaggagaacttggaaaacgttgtacgacgtcattaataacgattccgttcttcccgttcgtgtctataaggatattctttcattgcgaaggtaagcccttttgggtctagatacggactatactcaaaaacccacagaccttccacttggagttgttttaggagacggagtagtagagaaaacttgtggcaccttcccagtcggttccctacagactctccttagtagctcctaagatcgtcgagttacacgacgacattgttccgactgacgtagaggcattactttaaaaaaaaaaaaaaaaaaaaaaaaaaaaaa

SEQ ID NO: 7 - DNA, 774 bp, Artificial Sequence
  transcript variant
gtgaggcatctataccgccacgccctatgtctttctcacgtataggtgtgctctcagctgccgttccggcgctgcttcacccctttccgcttatcgcggatggtaaagtcaaagtttactcagcggtcgctgttgacctcaggttctctatcaaaaatttgctggctaaaacggtcggagcttctgctccactctttccagcaatccttctgccagtcgccttcaaacttgcaatctgtggattcgtcgaacgtccgggtagtatagttatctgcatcgtggtcaccagtatcacagactacaaaatctcaatcctccattcccccgtcaggtctatctaaaattcaatcgctgtgtttgcggggtaaataataggacaagtccgtataatctacccaatcgcattcattccagtcagagggtaccaccgaatttcatcaacaacattaataattccataggaactacattcttaaatccttggaactccaaactcctaccttatcacggttctatccgtcgtcttagggtcggtctcctcgtagcatggcctcgttctcctcgccgtaattgcggtcgaaagtacttcagttatttatggtgaggcttgtccgcgagtgtcaaccgggttttacaaaggagaacttccaacatcagtgtatgggatgtttcaaacacccccagagacggagacaatagtgtggtcacgtacatttaggaagataaaaataacaacaacagaagaaaaaaaaaaaaaaaaaaaaaaaaaaaaaa

SEQ ID NO: 8 - DNA, 732 bp, Artificial Sequence
  transcript variant
gtcttccacactccgctccctacgtgctgagagtggggtaagagcatgtaccttgcgcctcacaccttctgttgttgttatttttatcttcctaaatgtacgtgaccacactattgtctccgtctctgggggtgtttgaaacatcccatacactgatgttggaagttctcctttgtaaaacccggttgacactcgcggacaagcctcactactttcgaccgcaattacggcgaggagaacgaggccatgctacgaggagaccgaccctaagacgacggatagaaccgtgataaggtaggagtttggagttccaaggatttaagaatgtagttcctatggaattattaatgttgttgatgaaattcggtggtaccctctgactggaatgaatgcgattgggtagattatacggacttgtcctattatttaccccgcaaacacagcgattgaattttagatagacctgacgggggaatggaggattgagattttgtagtctcacagattgcaagtttgaaggcgactggcagaaggattgctggaaagagtggagcagaagctccgaccgttttagccagcaaatttttgatagagaacctgaggtcaacagcgaccgctgagtaaactttgactttaccatccgcgataagcggaaaggggtgaagcagcgccggaacggcagctgagagcacacctatacgtaaaaaaaaaaaaaaaaaaaaaaaaaaaaaa

SEQ ID NO: 9 - DNA, 494 bp, Artificial Sequence
  transcript variant
gggtgtttgaaacatcccatacactgatgttggaagttctcctttgtaaaacccggttgacactcgcggacaagcctcaccataaataactgaagtactttcgaccgcaattacggcgaggagaacgaggccatgctacgaggagaccgaccctaagacgacggatagaaccgtgataaggtaggagtttggagttccaaggatttaagaatgtagttcctatggaattattaatgttgttgatgaaattcggtgaaggattgctggaaagagtggagcagaagctccgaccgttttagccagcaaatttttgatagagaacctgaggtcaacagcgaccgctgagtaaactttgactttaccatccgcgataagcggaaaggggtgaagcagcgccggaacggcagctgagagcacacctatacgtgagaaagacatagggcgtggcggtatagatgcctcacaaaaaaaaaaaaaaaaaaaaaaaaaaaaaa

SEQ ID NO: 10 - DNA, 2081 bp, Artificial Sequence
  transcript variant
gtgtatttatccgctacgtggtggatgaacatggatgcgaacgacatttcgaaatatacgcaatgatatccaaccctaccgaaacagcaataattgtagaaggtagcatatcatgccgagagtttactacgttgtagcgagtttagttgaaatagtttgtgatgtgtaaactaaaacataccaaatggtaaaacttgtcacccccatttacattgcgacagacacagttatggagtggatggaagtgtgttcgactgtcaagacccttctataatagtcgaaccagtacggtaagtgggcaacatgcccatataagtcgaagcatttcaaatggttcatccagtagacgacgatgtcctagacagtcatgtctcttccccatttgaagtcatgtagtggttgtctactttttcattgaagacgtccacctcaacgctatgaacgttagttgagacaatgttaaagcaaacgacaacgtcattgtgatctacatacacagtggatggttagcgtaaacatggtggaacgtactttgactgcgctgcaagaaatggttgggtcgatcgtaatgctagtcgttacatcggaacaagccaaaacaaatcattcgctggatttagacctactgcacgacgacgtcgacacaagacattcttgaaaggaattcaatgcagaaactcctatgcacgtcgaactagtctcttgctcagcgctagtccatgaaaatgtcctagctttgaacgtttatcaaatgcaagttgtgggagttagtcatgtgagagttgtgcaagaaagtgttaacgttctagccgtgctcagtaacaattaccattcggcggtaacaaacgtaagttgtcactgcactcatgagcatgaagttagaccagtagttgggtcagaaattagacgtggtttagtctggttaccgtggaaagaatagctgaactcaaagaagccgacaaagataaacaaagaagaaacggttaatacgattgaggagaaatattcaatccaacggcaactattaacgtttcaactagaatctacgtttcatacgcggattccacatccgttcttgcaattaaagaaacgatgtagaaaacgctttggttggcgacaacttgggcggcaaaataattatggtaggtaattgaagtagcgttaaaacgcaaaaagaaggaagcacggatcactgcaaaaaggactactcaataatggtttctaaagtcattatgctggtgctccctatggcggtggtcagtactgtaactaaagatggattacggcacttgtagagcacgtatcagacccagctttgaaagaaggctgagttcggttcgggtttcacgtaggcctagaacgaggtatagaagtggttaacaaagatttggttaccatgtaagaagcggtagacgccatggcctagtaggaagaatgcttgttcacggagccgacgaagttagacgagtggcagaagaaagagcattatcttggtactcggactgaatgcgtactacggtcgtccaagttgcaagaggtattagagtcattcgaatagctgtgggagtggtatttatagcataataagtgtaaaaaacattcccaacagcatatgtgtagccaagaagcgttgtgctcgcgactaaaagtcaggtagcagcaggcattaacccagtgatagaacatcaaagtcaaataagtatggtttagcattactgcgtatcttgcgattgcgtgctggtggtcaacagtgcaaacctagtggcttcgcactcaaatgtagacaagcattaaccaactacttctaacgtatgttcaggaagaatggctattctcgtcaggtgaatgcgtaatcgaatgagtagtatggtcgaacgtcccgctatagtctgacacgattcaggcaaagttggagtgcaaagccatgatttggtcgatgcggcaaatgttgcttaggactattctatggtcttgcgtaattgtgaagatttgccagttatctaaggagacgtggtgattcgctctatagctgtatctaatctgccagattgaaaaaaaaaaaaaaaaaaaaaaaaaaaaaa

SEQ ID NO: 11 - DNA, 2001 bp, Artificial Sequence
  transcript variant
gttggtgtatttatccgctacgtggtggatgaacatggatgcgaacgacatttcgaaatatacgcaatgatatccaaccctaccgaaacagcaataattgtagaaggtagcatatcatgccgagagtttactacgttgtagcgagtttagttgaaatagtttgtgatgtgtaaactaaaacataccaaatggtaaaacttgtcacccccatttacattgcgacagacacagttatggagtggatggaagtgtgttcgactgtcaagacccttctataatagtcgaaccagtacggtaagtgggcaacatgcccatataagtcgaagcatttcaaatggttcatccagtagacgacgatgtcctagacagtcatgtctcttccccatttgaagtcatgtagtggttgtctactttttcattgaagacgtccacctcaacgctatgaacgttagttgagacaatgttaaagcaaacgacaacgtcattgtgatctacatacacagtggatggttagcgtaaacatggtggaacgtactttgactgcgctgcaagaaatggttgggtcgatcgtaatgctagtcgttacatcggaacaagccaaaacaaatcattcgctggatttagacctactgcacgacgacgtcgacacaagacattcttgaaagcgctagtccatgaaaatgtcctagctttgaacgtttatcaaatgcaagttgtgggagttagtcatgtgagagttgtgcaagaaagtgttaacgttctagccgtgctcagtaacaattaccattcggcggtaacaaacgtaagttgtcactgcactcatgagcatgaagttagaccagtagttgggtcagaaattagacgtggtttagtctggttaccgtggaaagaatagctgaactcaaagaagccgacaaagataaacaaagaagaaacggttaatacgattgaggagaaatattcaatccaacggcaactattaacgtttcaactagaatctacgtttcatacgcggattccacatccgttcttgcaattaaagaaacgatgtagaaaacgctttggttggcgacaacttgggcggcaaaataattatggtaggtaattgaagtagcgttaaaacgcaaaaagaaggaagcacggatcactgcaaaaaggactactcaataatggtttctaaagtcattatgctggtgctccctatggcggtggtcagtactgtaactaaagatggattacggcacttgtagagcacgtatcagacccagctttgaaagaaggctgagttcggttcgggtttcacgtaggcctagaacgaggtatagaagtggttaacaaagatttggttaccatgtaagaagcggtagacgccatggcctagtaggaagaatgcttgttcacggagccgacgaagttagacgagtggcagaagaaagagcattatcttggtactcggactgaatgcgtactacggtcgtccaagttgcaagaggtattagagtcattcgaatagctgtgggagtggtatttatagcataataagtgtaaaaaacattcccaacagcatatgtgtagccaagaagcgttgtgctcgcgactaaaagtcaggtagcagcaggcattaacccagtgatagaacatcaaagtcaaataagtatggtttagcattactgcgtatcttgcgattgcgtgctggtggtcaacagtgcaaacctagtggcttcgcactcaaatgtagacaagcattaaccaactacttctaacgtatgttcaggaagaatggctattctcgtcaggtgaatgcgtaatcgaatgagtagtatggtcgaacgtcccgctatagtctgacacgattcaggcaaagttggagtgcaaagccatgatttggtcgatgcggcaaatgttgcttaggactattctatggtcttgcgtaattgtgaagatttgccagttatctaaggagacgtggtgaaaaaaaaaaaaaaaaaaaaaaaaaaaaaa

SEQ ID NO: 12 - DNA, 716 bp, Artificial Sequence
  transcript variant
gctacgtggtggatgaacatggatgcgaacgacatttcgaaatatacgcaatgatatccaaccctaccgaaacagcaataattgtagaaggtagcatatcatgccgagtcatcgacatgcctttatcgacacacgacgtgattggagtttactacgttgtagcgagtttagttgaaatagtttgtgatgtgtaaactaaaacataccaaatggtaaaacttgtcacccccatttacattgcgacagacacagttatggagtggatggaagtgtgttcgactgtcaagacccttctataatagtcgaaccagtacggtaagtgggcaacatgcccatataagtcgaagcatttcaaatggttcatccagtagacgacgatgtcctagacagtcatgtctcttccccatttgaagtcatgtagtggttgtctactttttcattgaagacgtccacctcaacgctatgaacgttagttgagacaatgttaaagcaaacgacaacgtcattgtgatctacatacacagtggatggttagcgtaaacatggtggaacgtactttgactgcgctgcaagaaatggttgggtcgatcgtaatgctagtcgttacatcggaacaagccaaaacaaatcattcgctggatttagacctactgcacgacgacgtcgacacaagacattcttgaaagaaaaaaaaaaaaaaaaaaaaaaaaaaaaaa

SEQ ID NO: 13 - DNA, 770 bp, Artificial Sequence
  transcript variant
gtaaaacttgtcacccccatttacattgcgacagacacagttatggagtggatggaagtgtgttcgactgtcaagacccttctataatagtcgaaccagtacggtaagtgggcaacatgcccatataagtcgaagcatttcaaatggttcatccagtagacgacgatgtcctagacagtcatgtctgtcacatctatcacgcctcctacgttgtgccataacgaagaataatagtgataagagacatcgaagctgtcgtagtcgttcgctaaattgcttacaatttagtgctctaagtgaacaatgtttcatcttgagaagcaaacgaagtagaagttgacgacgcattcgaagacgtggacaatgtgacacgagtatcgaaacatgatccaacgaacatcgaagaagttactactgaactacgggtcagcttccccatttgaagtcatgtagtggttgtctactttttcattgaagacgtccacctcaacgctatgaacgttagttgagacaatgttaaagcaaacgacaacgtcattgtgatctacatacacagtggatggttagcgtaaacatggtggaacgtactttgactgcgctgcaagaaatggttgggtcgatcgtaatgctagtcgttacatcggaacaagccaaaacaaatcattcgctggatttagacctactgcacgacgacgtcgacacaagacattcttgaaaggtaattgacgtggacgtttcagaaaaaaaaaaaaaaaaaaaaaaaaaaaaaa

SEQ ID NO: 14 - DNA, 553 bp, Artificial Sequence
  transcript variant
gccgcatcgaccaaatcatggctttgcactccaactttgcctgaatcgtgtcagactatagcgggacgttcgaccatactactcattcgattacgcattcacctgacgagaatagccattcttcctgaacatacgttagaagtagttggttaatgcttgtctacatttgagtgcgaagccactaggtttgcactgttgaccaccagcacgcaatcgcaagatacgcagtaatgctaaaccatacttatttgactttgatgttctatcactgggttaatgcctgctgctacctgacttttagtcgcgagcacaacgcttcttggctacacatatgctgttgggaatgttttttacacttattatgctataaataccactcccacagctattcgaatgactctaatacctcttgcaacttggacgaccgtagtacgcattcagtccgagtaccaagataatgctctttcttctgccactcgtctaacttcgtcggctccgtgaacaagcattcttcctactaggcaaaaaaaaaaaaaaaaaaaaaaaaaaaaaa

SEQ ID NO: 15 - DNA, 454 bp, Artificial Sequence
  transcript variant
gttgaggtggacgtcttcaatgaaaaagtagacaaccactacatgacttcaaatggggaagctgacccgtagttcagtagtaacttcttcgatgttcgttggatcatgtttcgatactcgtgtcacattgtccacgtcttcgaatgcgtcgtcaacttctacttcgtttgcttctcaagatgaaacattgttcacttagagcactaaattgtaagcaatttagcgaacgactacgacagcttcgatgtctcttatcactattattcttcgttatggcacaacgtaggaggcgtgatagatgtgacagacatgactgtctaggacatcgtcgtctactggatgaaccatttgaaatgcttcgacttatatgggcatgttgcccacttaccgtactggttcgactattatagaagggtcttgacagaaaaaaaaaaaaaaaaaaaaaaaaaaaaaa

SEQ ID NO: 16 - DNA, 2497 bp, Artificial Sequence
  transcript variant
gtggagaagcaaatacttggataccgaatttagaggccataggttatggaaaaagtcagtggattagatagtaaaagtcgaaatctttatattcggttcgatgtactacgttattcgcgactgttctgtcatgatagttttttatatagtcctaataaaaggagtttttaaagtaaatgacatttcagtagtaaaagtttaagagctttttgttctgccagacgttctgatagttgaggaaaacgtgtggtcagctaataacttgtggtatggagtaaacgaacatccaacagtatgtacaatcgtatgagaaaggacaaatctgaagacgatattagagggagtccaacaagtttgtgatgattcacgtaaggaaatcgaaatgtaagattattcgtcaatggaggtataagacaacacaccaagtaattatacgcgacgagttttcatgttgacgatccctgagactatatcatacaaaattgacccaaataataaactcgttccaatagttgaagtgttgattaacacattgagacaagttgtccgtactttaatcatcaaagttttggactgacctataaatgaaatattcgcgttgtcttcagtttaagaagtgatattattttcggtttcaagcctatgtggagagatacaggaaataggtaaactataactaatataaatatacgcagacgaagcctgttaactttaccaaatccaaatagcgggagacactaaacttacaagaaatgtacggtaagacagggaaacagggtttgaagtttggaggtacaaaatcttaatccttcacaactgaatcaacatttacattcggttacgttcggggtttgtagtagtaattgttgaggtaattttaattgcacttacagacgtggatttggtgaaacattatgtggtagattcatatttccgaatcttaatagacgattttatgatggtgatcgtggtttcttttcaaggtttggtggacgaaaatgaaaaaatcacaatttaacgtttcatattcatcacaatccgaaatcgagatggagagaaagtttgactaaactttgttacagtatttttgaaggcaatcaacctggaactttggatttcatcaagtaaacacccatatttagcgaaaatgcaagctaactgcgaactaacaaggtaactctttttcgatttcaaaatatggtcagtagcaatatgttaagtgatccattttggaggggtggggatttgttcaatgaatgaggcaataaaccaccgcaacctctgtaattgacgagaaacttgtataaggtcatcaaaaagaatagatgaacataaagattgaatacggctgggtgaggttaattcagatttcccaaattatgtagatgaaaagatggtaagtttattgataggtaaaaaatcaagagagggtaataaagaagaaagaataatcaaaagatagagcatgcaaacattacatggtagtattgttataggcggtatattggtaaatgacgatccttgacttagttttttacatcgaacggttgcaaatcctagcatacttgatattaatagtagatactgaaatatatctgagtatatcaagggaaatcgagatgtaacaataagtcgaggaaattaaggtcaatttagtgcttatcatagaaataactacttaagcccttaacgaactaactcaaattaacgaggtagaggttattctgaattgtacgaacgtagtcgaagtttgttaccaagggtaaagccaaaacaaaacgatttgacaagagaatctattccatgtagtagtgcgtttgtacgacgttctattcgatgtaaatcattaggacgagggtttgaagcaactcggaaagatggtcggttagaatttaaaagtactgaacggaattaacgaagttggctactacctaatagtctttgcttaggatttagtagttcgcaattgggtcaaagtggtcgctttggtcgtcgacgtcaagactcaacaagtcatttaccgctgtacgaaccatctcatttaacaggttctcaaccaaatagcggtaggagtagaaagcacttaccatcgtacgaactttgacaacgaaaggttcaaaggtaaccaaggcgtagtagtgagttaggtcaatgtataaaaactccctttcttattttgagtcgtcaatgtagtcgagaaagtatgcacttagtgccattattattagacaagatagtccgttctttagtcgaagttcttgttgtaataacaaaagtagagcagattacgatccgaaatttcatggacacagatatttgagatcaacatttgattcgttgacgtatttatgttgattcggttagcgagagttacaaagttagtaatagaaagaaagaggaaataataatcaaaagattaagcatgcaaacattaagaggacacatatgtattggtggcatttgcgttaaaaaaaaaaaaaaaaaaaaaaaaaaaaaa

SEQ ID NO: 17 - DNA, 1837 bp, Artificial Sequence
  transcript variant
gataccgaatttagaggccataggttatggaaaaagtcagtggagtaaacgaacatccaacagtatgtacaatcgtatgagaaaggacaaatctgaagacgatattagagggagtccaacaagtttgtgatgattcacgtaaggaaatcgaaatgtaagattattcgtcaatggaggtataagacaacacaccaagtaattatacgcgacgagttttcatgttgacgatccctgagactatatcatacaaaattgacccaaataataaactcgttccaatagttgaagtgttgattaacacattgagacaagttgtccgtactttaatcatcaaagttttggactgacctataaatgaaatattcgcgttgtcttcagtttaagaagtgatattattttcggtttcaagcctatgtggagagatacaggaaataggtaaactataactaatataaatatacgcagacgaagcctgttaactttaccaaatccaaatagcgggagacactaaacttacaagaaatgtacggtaagacagggaaacagggtttgaagtttggaggtacaaaatcttaatccttcacaactgaatcaacatttacattcggttacgttcggggtttgtagtagtaattgttgaggtaattttaattgcacttacagacgtggatttggtgaaacattatgtggtagattcatatttccgaatcttaatagacgattttatgatggtgatcgtggtttcttttcaaggtttggtggacgaaaatgaaaaaatcacaatttaacgtttcatattcatcacaatccgaaatcgagatggagagaaagtttgactaaactttgttacagtatttttgaaggcaatcaacctggaactttggatttcatcaagtaaacacccatatttagcgaaaatgcaagctaactgcgaactaacaaggtaactctttttcgatttcaaaatatggtcagtagcaatatgttaagtgatccattttggaggggtggggatttgttcaatgaatgaggcaataaaccaccgcaacctctgtaattgacgagaaacttgtataaggtcatcaaaaagaatagatgaacataaagattgaatacggctgggtgaggttaattcagatttcccaaattatgtagatgaaaagatggtaagtttattgataggtaaaaaatcaagagagggtaataaagaagaaagaataatcaaaagatagagcatgcaaacattacatggtagtattgttataggcggtatattggtaaatgacgatccttgacttagttttttacatcgaacggttgcaaatcctagcatacttgatattaatagtagatactgaaatatatctgagtatatcaagggaaatcgagatgtaacaataagtcgaggaaattaaggtcaatttagtgcttatcatagaaataactacttaagcccttaacgaactaactcaaattaacgaggtagaggttattctgaattgtacgaacgtagtcgaagtttgttaccaagggtaaagccaaaacaaaacgatttgacaagagaatctattccatgtagtagtgcgtttgtacgacgttctattcgatgtaaatcattaggacgagggtttgaagcaactcggaaagatggtcggttagaatttaaaagtactgaacggaattaacgaagttggctactacctaatagtctttgcttaggatttagtagttcgcaattgggtcaaagtggtcgctttggtcgtcgacgtcaagactcaacaagtcatttaccgctgtacgaaccatcaaaaaaaaaaaaaaaaaaaaaaaaaaaaaa

SEQ ID NO: 18 - DNA, 2048 bp, Artificial Sequence
  transcript variant
gataccgaatttagaggccataggttatggaaaaagtcagtggattagatagtaaaagtcgaaatctttatattcggttcgatgtactacgttattcgcgactgttctgtcatgatagttttttatatagtcctaataaaaggagtttttaaagtaaatgacatttcagtagtaaaagtttaagagctttttgttctgccagacgttctgatagttgaggaaaacgtgtggtcagctaataacttgtggtatggagtaaacgaacatccaacagtatgtacaatcgtatgagaaaggacaaatctgaagacgatattagagggagtccaacaagtttgtgatgattcacgtaaggaaatcgaaatgtaagattattcgtcaatggaggtataagacaacacaccaagtaattatacgcgacgagttttcatgttgacgatccctgagactatatcatacaaaattgacccaaataataaactcgttccaatagttgaagtgttgattaacacattgagacaagttgtccgtactttaatcatcaaagttttggactgacctataaatgaaatattcgcgttgtcttcagtttaagaagtgatattattttcggtttcaagcctatgtggagagatacaggaaataggtaaactataactaatataaatatacgcagacgaagcctgttaactttaccaaatccaaatagcgggagacactaaacttacaagaaatgtacggtaagacagggaaacagggtttgaagtttggaggtacaaaatcttaatccttcacaactgaatcaacatttacattcggttacgttcggggtttgtagtagtaattgttgaggtaattttaattgcacttacagacgtggatttggtgaaacattatgtggtagattcatatttccgaatcttaatagacgattttatgatggtgatcgtggtttcttttcaaggtttggtggacgaaaatgaaaaaatcacaatttaacgtttcatattcatcacaatccgaaatcgagatggagagaaagtttgactaaactttgttacagtatttttgaaggcaatcaacctggaactttggatttcatcaagtaaacacccatatttagcgaaaatgcaagctaactgcgaactaacaaggtaactctttttcgatttcaaaatatggtcagtagcaatatgttaagtgatccattttggaggggtggggatttgttcaatgaatgaggcaataaaccaccgcaacctctgtaattgacgagaaacttgtataaggtcatcaaaaagaatagatgaacataaagattgaatacggctgggtgaggttaattcagatttcccaaattatgtagatgaaaagatggtaagtttattgataggtaaaaaatcaagagagggtaataaagaagaaagaataatcaaaagatagagcatgcaaacattacatggtagtattgttataggcggtatattggtaaatgacgatccttgacttagttttttacatcgaacggttgcaaatcctagcatacttgatattaatagtagatactgaaatatatctgagtatatcaagggaaatcgagatgtaacaataagtcgaggaaattaaggtcaatttagtgcttatcatagaaataactacttaagcccttaacgaactaactcaaattaacgaggtagaggttattctgaattgtacgaacgtagtcgaagtttgttaccaagggtaaagccaaaacaaaacgatttgacaagagaatctattccatgtagtagtgcgtttgtacgacgttctattcgatgtaaatcattaggacgagggtttgaagcaactcggaaagatggtcggttagaatttaaaagtactgaacggaattaacgaagttggctactacctaatagtctttgcttaggatttagtagttcgcaattgggtcaaagtggtcgctttggtcgtcgacgtcaagactcaacaagtcatttaccgctgtacgaaccatcaaaaaaaaaaaaaaaaaaaaaaaaaaaaaa

SEQ ID NO: 19 - DNA, 1113 bp, Artificial Sequence
  transcript variant
gataccgaatttagaggccataggttatggaaaaagtcagtggtacgaattacgaacaccttaacattagggaaacttagatagttgtacaaagtaacgtataacaagtatcgcgtatggattagatagtaaaagtcgaaatctttatattcggttcgatgtactacgttattcgcgactgttctgtcatgatagttttttatatagtcctaataaaaggagtttttaaagtaaatgacatttcagtagtaaaagtttaagagctttttgttctgccagacgttctgatagttgaggaaaacgtgtggtcagctaataacttgtggtatggagtaaacgaacatccaacagtatgtacaatcgtatgagaaaggacaaatctgaagacgatattagagggagtccaacaagtttgtgatgattcacgtaaggaaatcgaaatgtaagattattcgtcaatggaggtataagacaacacaccaagtaattatacgcgacgagttttcatgttgacgatccctgagactatatcatacaaaattgacccaaataataaactcgttccaatagttgaagtgttgattaacacattgagacaagttgtcctattgttataggcggtatattggtaaatgacgatccttgacttagttttttacatcgaacggttgcaaatcctagcatacttgatattaatagtagcatcgtacgaactttgacaacgaaaggttcaaaggtaaccaaggcgtagtagtgagttaggtcaatgtataaaaactccctttcttattttgagtcgtcaatgtagtcgagaaagtaagatgcacttagtgccattattattagacaagatagtccgttctttagtcgaagttcttgttgtaataacaaaagtagagcagattacgatccgaaatttcatggacacagatatttgagatcaacatttgattcgttgacgtatttatgttgattcggttagcgagagttacaaagttagtaatagaaagaaagaggaaataataatcaaaagattaagcatgcaaacattaagaggacacatatgtattggtggcatttgcgaaaaaaaaaaaaaaaaaaaaaaaaaaaaaa

SEQ ID NO: 20 - DNA, 466 bp, Artificial Sequence
  transcript variant
gtacgaattacgaacaccttaacattagggaaacttagatagttgtacaaagtaacgtataacaagtatcgcgtatggattagatagtaaaagtcgaaatctttatattcggttcgatgtactacgttattcgcgactgttctgtcatgatagttttttatatagtcctaataaaaggagtttttaaagtaaatgacatttcagtagtaaaagtttaagagctttttgttctgccagacgttctgatagttgaggaaaacgtgtggtcagctaataacttgtggtatgtttggaggtacaaaatcttaatccttcacaactgaatcaacatttacattcggttacgttcggggtttgtagtagtaattgttgaggtaattttaattgcacttacagacgtggatttggtgaaacattatgtggtagattcatatttaaaaaaaaaaaaaaaaaaaaaaaaaaaaaa

SEQ ID NO: 21 - DNA, 2403 bp, Artificial Sequence
  transcript variant
gtggagaagcaaatacttggataccgaatttagaggccataggttatggaaaaagtcagtggtacgaattacgaacaccttaacattagggaaacttagatagttgtacaaagtaacgtataacaagtatcgcgtatggagtaaacgaacatccaacagtatgtacaatcgtatgagaaaggacaaatctgaagacgatattagagggagtccaacaagtttgtgatgattcacgtaaggaaatcgaaatgtaagattattcgtcaatggaggtataagacaacacaccaagtaattatacgcgacgagttttcatgttgacgatccctgagactatatcatacaaaattgacccaaataataaactcgttccaatagttgaagtgttgattaacacattgagacaagttgtccgtactttaatcatcaaagttttggactgacctataaatgaaatattcgcgttgtcttcagtttaagaagtgatattattttcggtttcaagcctatgtggagagatacaggaaataggtaaactataactaatataaatatacgcagacgaagcctgttaactttaccaaatccaaatagcgggagacactaaacttacaagaaatgtacggtaagacagggaaacagggtttgaagtttggaggtacaaaatcttaatccttcacaactgaatcaacatttacattcggttacgttcggggtttgtagtagtaattgttgaggtaattttaattgcacttacagacgtggatttggtgaaacattatgtggtagattcatatttccgaatcttaatagacgattttatgatggtgatcgtggtttcttttcaaggtttggtggacgaaaatgaaaaaatcacaatttaacgtttcatattcatcacaatccgaaatcgagatggagagaaagtttgactaaactttgttacagtatttttgaaggcaatcaacctggaactttggatttcatcaagtaaacacccatatttagcgaaaatgcaagctaactgcgaactaacaaggtaactctttttcgatttcaaaatatggtcagtagcaatatgttaagtgatccattttggaggggtggggatttgttcaatgaatgaggcaataaaccaccgcaacctctgtaattgacgagaaacttgtataaggtcatcaaaaagaatagatgaacataaagattgaatacggctgggtgaggttaattcagatttcccaaattatgtagatgaaaagatggtaagtttattgataggtaaaaaatcaagagagggtaataaagaagaaagaataatcaaaagatagagcatgcaaacattacatggtagtattgttataggcggtatattggtaaatgacgatccttgacttagttttttacatcgaacggttgcaaatcctagcatacttgatattaatagtagatactgaaatatatctgagtatatcaagggaaatcgagatgtaacaataagtcgaggaaattaaggtcaatttagtgcttatcatagaaataactacttaagcccttaacgaactaactcaaattaacgaggtagaggttattctgaattgtacgaacgtagtcgaagtttgttaccaagggtaaagccaaaacaaaacgatttgacaagagaatctattccatgtagtagtgcgtttgtacgacgttctattcgatgtaaatcattaggacgagggtttgaagcaactcggaaagatggtcggttagaatttaaaagtactgaacggaattaacgaagttggctactacctaatagtctttgcttaggatttagtagttcgcaattgggtcaaagtggtcgctttggtcgtcgacgtcaagactcaacaagtcatttaccgctgtacgaaccatctcatttaacaggttctcaaccaaatagcggtaggagtagaaagcacttaccatcgtacgaactttgacaacgaaaggttcaaaggtaaccaaggcgtagtagtgagttaggtcaatgtataaaaactccctttcttattttgagtcgtcaatgtagtcgagaaagtgtccaagcaaaacgtaacgaaacggttgagtaaggacttgcacactatgcccttgcgggtttacctgcttgacgtagtcctgccacttattatccgtgattgttacctaatggacaacctaatcgttagcttaaagaagatgcacttagtgccattattattagacaagatagtccgttctttagtcgaagttcttgttgtaataacaaaagtagagcagtattttgacgtatagggagacagtcattaggtcattaacccagttactaaggacaacgtaaccatcgaagttattgaacttcagaaaaaaaaaaaaaaaaaaaaaaaaaaaaaa

SEQ ID NO: 22 - DNA, 809 bp, Artificial Sequence
  transcript variant
gataccgaatttagaggccataggttatggaaaaagtcagtggtacgaattacgaacaccttaacattagggaaacttagatagttgtacaaagtaacgtataacaagtatcgcgtatgatagtaaaagtcgaaatctttatattcggttcgatgtactacgttattcgcgactgttctgtcatgatagttttttatatagtcctaataaaaggagtttttaaagtaaatgacatttcagtagtaaaagtttaagagctttttgttctgccagacgttctgatagttgaggaaaacgtgtggtcagctaataacttgtggagtaaacgaacatccaacagtatgtacaatcgtatgagaaaggacaaatctgaagacgatattagagggagtccaacaagtttgtgatgattcacgtaaggaaatcgaaatgtaagattattcgtcaatggaggtataagacaacacaccaagtaattatacgcgacgagttttcatgttgacgatccctgagactatatcatacaaaattgacccaaataataaactcgttccaatagttgaagtgttgattaacacattgagacaagttgtccgattacgatccgaaatttcatggacacagatatttgagatcaacatttgattcgttgacgtatttatgttgattcggttagcgagagttacaaagttagtaatagaaagaaagaggaaataataatcaaaagattaagcatgcaaacattaagaggacacatatgtattggtggcatttgcgttaaaaaaaaaaaaaaaaaaaaaaaaaaaaaa

SEQ ID NO: 23 - DNA, 509 bp, Artificial Sequence
  transcript variant
ggcctctaaattcggtatccaagtatttgcttctccacctgccaagcgcacataaattctttgcgagtgttgtttggccacttttggtagctcctgtttcttggcaattttggctgacacgttcagtttcttttgctccaacttcgtaagcagttagtgtaggcgtgcgctaaggcattgcgctactcgcttccatcgttggttctaccacccatatgccatggcgtcctgtaagtttgcgcctaattactcgaagcgctttcatttctacgaaacgttttggaataatgtcaacttgggcattgttgaaactacggcttccttaatgctcttgacaaccttgtttagttgttgttcttccttcttccagcatttaataaccggcttttgttttaactccttcgctttttcgactttctcctttagcaccgcaacgttctttttaagctacaacgctttcttgaaatgcttctcgtcataaaaaaaaaaaaaaaaaaaaaaaaaaaaaa

SEQ ID NO: 24 - DNA, 826 bp, Artificial Sequence
  transcript variant
gtattagggcgcattgcgctttgccgaacgcgtaattacagaacttgtggtttcggttttgtcgatagcgactggaactgccgaactttgtttaataattacacgttaatctgggacaaaaggcaagctgaagatcgcagtaacagttggttctgcgaaagttgaccaacctatgcgactttctggttttgcctgttatgaacaacgttggcaggtaaagaagcggctgactgctggtcgaagagccaaatggtcaacattagcatagcttgtttcgtaatcgattggctcaactgccgccgtgtccacgcgttaaacgcggttagtaacatccactgaactttcttcgccaacagtacaagctggcagttgcatgtctttagtacaggagattgcaacgctacctacgcaagctttgactgcgatgctacaccgcacgatagctcgcgtacctacacttttacgcgctactactccgcgaacataagccacttcatgttgaacgaatggagaacgttatggttcacttctttatgcgaccgaagaaggcgcagtgtttgcttgacaatttactgtcgtgtcttcggtaacagatatgctaccaagcgacctaaccactttaagcagcttcaccgtcttacgagacgttaacctaacgcaaatgccaccaatacatatgtgtcctcttaatgtttgcatgcttaatcttttgattattatttcctctttctttctattactaactttgtaactctcgctaaccgaatcaacataaatacgtcaacgaatcaaatgtaaaaaaaaaaaaaaaaaaaaaaaaaaaaaa

SEQ ID NO: 25 - DNA, 619 bp, Artificial Sequence
  transcript variant
gcgtaattacagaacttgtggtttcggttttgtcgatagcgactggaactgccgaactttgtttaataattacacgttaatctgggacaaaaggcaagctgaagatcgcagtaacagttggttctgcgaaagttgaccaacctatgcgactttctggttttgcctgttatgaacaacgttggcaggtaaagaagcggctgactgctggtcgaagagccaaatggtcaacattagcatagcttgtttcctctttttcgttgcggagttaagtaggagaacgttatggttcacttctttatgcgaccgaagaaggcgcagtgtttgcttgacaatttactgtcgtgtcttcggtaacagatatgctaccaagcgacctaaccaccttcaccgtcttacgagacgttaacctaacgcaaatgccaccaatacatatgtgtcctcttaatgtttgcatgcttaatcttttgattattatttcctctttctttctattactaactttgtaactctcgctaaccgaatcaacataaatacgtcaacgaatcaaatgttgatctcaaatatctgtgtccatgaaatttcggatcgtaaaaaaaaaaaaaaaaaaaaaaaaaaaaaa

SEQ ID NO: 26 - DNA, 191 bp, Artificial Sequence
  transcript variant
gctgaccacacgttttcctcaactatcagaacgtctggcagaacaaaaagctcttaaacttttactactgaaatgtcatttactttaaaaactccttttattaggactatataaaaaactatcatgacagaacagtcgcgaataacgtagtacatcgaaccaaaaaaaaaaaaaaaaaaaaaaaaaaaaaa

SEQ ID NO: 27 - DNA, 2283 bp, Artificial Sequence
  transcript variant
gttgaacttatacagaaatactaaaagtcgaacaaccattcgatttaggaatacagaacgataacgcagcagaagtagttgaccaccgtgtaacttgaatggtgatggtcctggttctattaatacaaatccttttacttatgctccgtgatacagaacaactaaaagaactaaaagagaagaacgacgtgcacgtgctaattatgcgaattaacatcgggttagaaaaagtaaactaaaggaaaatgggtaaggcatatgccttactaaattgtgtaaaagaagttctaataagaaccggaatgtatgtaattattcgcaagggttccataaggcacatatacaaatttagaaacaacccgttacattaacaaaggtgaacggtgtttcacagatattagaccattaggtaaccaatgacatttcactatcgaaaagggtatagtattaactactacaactaatccgactcgtcgaggtgatttatacaggactgcaggtagcaaacgacgaggtggacgagggtaaggtggccgacgaaagggaggacatgcacctagttgaacacgactaggaggacgatggccactacggagtggaacacaaaggtaaagttgcaataataaccagtacaacaaaagcatacgtggaaggtgacaagcaaacgatgtcttgaacaacaccgtcttcattgtttaccatttgctgttggatttgatatttagagcgtatgttgaagaagttggaactctggacacattagagacttattggatcgatcaagaggaatgcaatacgaagtagtttcactttcgtaggttaccctataacacgcaaatagatgtaatcaacctcttattaatcatacactagacatcagatgttaatgacctaacgattatagtgctgaacaacgtctacgacaatataaacctttgcaaagactggtcaaacatcaatgttaaacacgtccagataaaagcaaaaaggtaagacgaggattacggaataattaatatagtgcttgttccaatcggcccggcttcagtcattcccggtggcgaagccataacatttaaaaatagcctgttaacttcaagctgtagtagcctaaacaggtttcctaatagtatgcaaacaacatagttcaatagaagttattaataaacatcaaattgtctttgaacaacacaaacacgtaagctttcggcaactaaattaactaaaaaataactataattacacagaacacgaagtcatctgtttcctattaaaaaataggtacttgacaggttacaatataacctgtttctagcatgtataacaaaattaagcgacgaccgagcgacgacaacaagcagcagccaggtgggcaaaaggctaagactgctttgatgtcctgagccaacttgccgatacgcagcaacattttagaaacgtcatcctgaccgccgccgccattgccataaatgatagcttggcggtagccgcccaaaactatgaaaaaaattaaattaaggaaagacataaacaaggtagttaagccatgcacctagaaaattttgaacggctcagctgcaacatattagcgctagaaatgacctaccataatgatatagaagataattaccattactgccaccgcctcctccgctgccgcctcctccatagcagcttctattcaaacaaactccgccgccgccaccgccgccataaccaccaccataaccaccgccgtatacacaaacgccgctccttctaagtcttagctattaataacaaccgtggaaacaaaaaacgtaatataggctacagctgtgtcaacagccaaatccataacaacaaaatccatggtgactgtaacagacactgttacaaccatattattaactagatagtggttacagataatcatgcagcaacaacatataaagaagacggttaaagttattgacttatgttagcatgtgcaaattaacataggctagtcttaacctgactcgctgtcgcgactggcatgcaaagtttgacacgccgcggctctagtacgcgtcatctttcagctgtaataactacaaacacatcaaaaaaagtcggtttaaaacaacttgtgaaacgtcaacttggtaaataaacctattattaaagaatctagatcaatgtccaaaaagattatttccattgttacgtctaaatacagattctgcgaaaacaagccattagtatagtagaagaactaaccatcgtatgttcaaaaaaaaaaaaaaaaaaaaaaaaaaaaaa

SEQ ID NO: 28 - DNA, 2089 bp, Artificial Sequence
  transcript variant
gtgtaaccatcttacggatgtaatctaacgtaaacaccagagaaacaaccatcaaaacggcataatgggcaagcattattaggaacatctaaatataaaaccattgccttaactcacataacgctacacttggtaacaccaccatatgcagtgcaagaacgttgggtaagagaacatcgaacgtatggtctgtttacataagctcaaaaataattttacagggtaaaacgtcaatcattacttaacagcagtaatgcttacaaatgtttcggttagtatttaaaaccgtaacgaacgccacgtgtaaaaacaagaggttttattaatattgggtatattagatgtatccgtcgattaacccaccataaccaaactaaattaaagcaacgacttatgcgaaatcctccttgtttacaaactaacagtaatgcaagtcgtaataaacgtcttaaatattttataggtaaaagatttggaccatatcctcagtactgtaatgataaacaccgacgaagtctacatcgttgcaacggaaaattccatgaaagtcgtatgttttatggtaaacttccgaatttagcaaaaagggttgtaaaaggtatacgtcatcatggtaagaaatacagctgtattagtatataaggttgtagaaaaccacataataatatgtctttagcactagacatcagatgttaatgacctaacgattatagtgctgaacaacgtctacgacaatataaacctttgcaaagactggtcaaacatcaatgttaaacacgtccagataaaagcaaaaaggtaagacgaggattacggaataattaatatagtgcttgttccaatcggcccggcttcagtcattcccggtggcgaagccataacatttaaaaatagcctgttaacttcaagctgtagtagcctaaacaggtttcctaatagtatgcaaacaacatagttcaatagaagttattaataaacatcaaattgtctttgaacaacacaaacacgtaagctttcggcaactaaattaactaaaaaataactataattacacagaacacgaagtcatctgtttcctattaaaaaataggtacttgacaggttacaatataacctgtttctagcatgtataacaaaattaagcgacgaccgagcgacgacaacaagcagcagccaggtgggcaaaaggctaagactgctttgatgtcctgagccaacttgccgatacgcagcaacattttagaaacgtcatcctgaccgccgccgccattgccataaatgatagcttggcggtagccgcccaaaactatgaaaaaaattaaattaaggaaagacataaacaaggtagttaagccatgcacctagaaaattttgaacggctcagctgcaacatattagcgctagaaatgacctaccataatgatatagaagataattaccattactgccaccgcctcctccgctgccgcctcctccatagcagcttctattcaaacaaactccgccgccgccaccgccgccataaccaccaccataaccaccgccgtatacacaaacgccgctccttctaagtcttagctattaataacaaccgtggaaacaaaaaacgtaatataggctacagctgtgtcaacagccaaatccataacaacaaaatccatggtgactgtaacagacactgttacaaccatattattaactagatagtggttacagataatcatgcagcaacaacatataaagaagacggttaaagttattgacttatgttagcatgtgcaaattaacataggctagtcttaacctgactcgctgtcgcgactggcatgcaaagtttgacacgccgcggctctagtacgcgtcatctttcagctgtaataactacaaacacatcaaaaaaagtcggtttaaaacaacttgtgaaacgtcaacttggtaaataaacctattattaaagaatctagatcaatgtccaaaaagattatttccattgttacgtctaaatacagattctgcgaaaacaagccattagtatagtagaagaactaaccatcgtatgaaaaaaaaaaaaaaaaaaaaaaaaaaaaaa

SEQ ID NO: 29 - DNA, 700 bp, Artificial Sequence
  transcript variant
gtgaaaggtgatacatatttacttgacttcttaagcagagagcgtcaaaacaggttgaacttatacagaaatactaaaagtcgaacaaccattcgatttaggagtgcagatacagaacaactaaaagaactaaaagagaagaacgacgtgcacgtgctaattatgcgaattaacatcgggttagaaaaagtaaactaaaggaaaatgggtaaggcatatgccttactaaattgtgtaaaagaagttctaataagaaccggaatgtatgtaattattcgcaagggttccataaggcacatatacaaatttagaaacaacccgttacattaacaaaggtgaacggtgtttcacagatattagaccattaggtaaccaatgacatttcactatcgaaaagggtatagtattaactactacaactaatccgactcgtcgaggtgatttatacaggactgcaggtagcaaacgacgaggtggacgagggtaaggtggccgacgaaagggaggacatgcacctagttgaacacgactaggaggacgatggccactacggagtggaacacaaaggtaaagttgcaataataaccagtacaacaaaagcatacgtggaaggtgacaagcaaacgatgtcttgaacaacaccgtcttcattgtttaccatttgctgttgaaaaaaaaaaaaaaaaaaaaaaaaaaaaaa

SEQ ID NO: 30 - DNA, 622 bp, Artificial Sequence
  transcript variant
gcaattaggatcaggtggttaatctgatacgatacagaacaactaaaagaactaaaagagaagaacgacgtgcacgtgctaattatgcgaattaacatcgggttagaaaaagtaaactaaaggaaaatgggtaaggcatatgccttactaaattgtgtaaaagaagttctaataagaaccggaatgtatgtaattattcgcaagggttccataaggcacatatacaaatttagaaacaacccgttacattaacaaaggtgaacggtgtttcacagatattagaccattaggtaaccaatgacatttcactatcgaaaagggtatagtattaactactacaactaatccgactcgtcgaggtgatttatacaggactgcaggtagcaaacgacgaggtggacgagggtaaggtggccgacgaaagggaggacatgcacctagttgaacacgactaggaggacgatggccactacggagtggaacacaaaggtaaagttgcaataataaccagtacaacaaaagcatacgtggaaggtgacaagcaaacgatgtcttgaacaacaccgtcttcattgtttaccatttgctgttgaaaaaaaaaaaaaaaaaaaaaaaaaaaaaa

SEQ ID NO: 31 - DNA, 656 bp, Artificial Sequence
  transcript variant
gccaaggtgaaccaggacgaagtcgatgtttcagaacctcctttaggccttttagacggtttaaacgaagcactagaccaagtaataaaagcggacgttgcacaggtacgtgcagatacagaacaactaaaagaactaaaagagaagaacgacgtgcacgtgctaattatgcgaattaacatcgggttagaaaaagtaaactaaaggaaaatgggtaaggcatatgccttactaaattgtgtaaaagaagttctaataagaaccggaatgtatgtaattattcgcaagggttccataaggcacatatacaaatttagaaacaacccgttacattaacaaaggtgaacggtgtttcacagatattagaccattaggtaaccaatgacatttcactatcgaaaagggtatagtattaactactacaactaatccgactcgtcgaggtgatttatacaggactgcaggtagcaaacgacgaggtggacgagggtaaggtggccgacgaaagggaggacatgcacctagttgaacacgactaggaggacgatggccactacggagtggaacacaaaggtaaagttgcaataataaccagtacaacaaaagcatacgtggaaggtgacaagaaaaaaaaaaaaaaaaaaaaaaaaaaaaaa

SEQ ID NO: 32 - DNA, 647 bp, Artificial Sequence
  transcript variant
gacatcagatgttaatgacctaacgattatagtgctgaacaacgtctacgacaatataaacctttgcaaagactggtcaaacatcaatgttaaacacgtccagataaaagcaaaaaggtaagacgaggattacggaataattaatatagtgcttgttccaatcggcccggcttcagtcattcccggtggcgaagccatgtcaccaataaaaactatcggcggcaatggaagtggtttttcggaaactgttacgggtgcaagcggccccagtgcagtttgtgccttgccaatcggcccagctttcaaacgcaaagttggacgacttattggcccattctgacaacgtcctgttaaactgcccggacgttcaaacggcggtatcggacgactaacgcgttacggcggacaactcgcccccagtcaacaacttggacacggtaaatttgaacgctaagtcaactgtagcagttaaacattgagtattaaaatagatttaagctagcgttaagaacattaaaaactaaccagccaaaccaaggattacggctgtggtgtaatcgattgcgaaatagcatgacaaaaaacttacagtttagaaggtggcggtattacttaagaaaaaaaaaaaaaaaaaaaaaaaaaaaaaa

SEQ ID NO: 33 - DNA, 2135 bp, Artificial Sequence
  transcript variant
gcagatacagaacaactaaaagaactaaaagagaagaacgacgtgcacgtgctaattatgcgaattaacatcgggttagaaaaagtaaactaaaggaaaatgggtaaggcatatgccttactaaattgtgtaaaagaagttctaataagaaccggaatgtatgtaattattcgcaagggttccataaggcacatatacaaatttagaaacaacccgttacattaacaaaggtgaacggtgtttcacagatattagaccattaggtaaccaatgacatttcactatcgaaaagggtatagtattaactactacaactaatccgactcgtcgaggtgatttatacaggactgcaggtagcaaacgacgaggtggacgagggtaaggtggccgacgaaagggaggacatgcacctagttgaacacgactaggaggacgatggccactacggagtggaacacaaaggtaaagttgcaataataaccagtacaacaaaagcatacgtggaaggtgacaagcaaacgatgtcttgaacaacaccgtcttcattgtttaccatttgctgttggatttgatatttagagcgtatgttgaagaagttggaactctggacacattagagacttattggatcgatcaagaggaatgcaatacgaagtagtttcactttcgtaggttaccctataacacgcaaatagatgtaatcaacctcttattaatcatacactagacatcagatgttaatgacctaacgattatagtgctgaacaacgtctacgacaatataaacctttgcaaagactggtcaaacatcaatgttaaacacgtccagataaaagcaaaaaggtaagacgaggattacggaataattaatatagtgcttgttccaatcggcccggcttcagtcattcccggtggcgaagccataacatttaaaaatagcctgttaacttcaagctgtagtagcctaaacaggtttcctaatagtatgcaaacaacatagttcaatagaagttattaataaacatcaaattgtctttgaacaacacaaacacgtaagctttcggcaactaaattaactaaaaaataactataattacacagaacacgaagtcatctgtttcctattaaaaaataggtacttgacaggttacaatataacctgtttctagcatgtataacaaaattaagcgacgaccgagcgacgacaacaagcagcagccaggtgggcaaaaggctaagactgctttgatgtcctgagccaacttgccgatacgcagcaacattttagaaacgtcatcctgaccgccgccgccattgccataaatgatagcttggcggtagccgcccaaaactatgaaaaaaattaaattaaggaaagacataaacaaggtagttaagccatgcacctagaaaattttgaacggctcagctgcaacatattagcgctagaaatgacctaccataatgatatagaagataattaccattactgccaccgcctcctccgctgccgcctcctccatagcagcttctattcaaacaaactccgccgccgccaccgccgccataaccaccaccataaccaccgccgtatacacaaacgccgctccttctaagtcttagctattaataacaaccgtggaaacaaaaaacgtaatataggctacagctgtgtcaacagccaaatccataacaacaaaatccatggtgactgtaacagacactgttacaaccatattattaactagatagtggttacagataatcatgcagcaacaacatataaagaagacggttaaagttattgacttatgttagcatgtgcaaattaacataggctagtcttaacctgactcgctgtcgcgactggcatgcaaagtttgacacgccgcggctctagtacgcgtcatctttcagctgtaataactacaaacacatcaaaaaaagtcggtttaaaacaacttgtgaaacgtcaacttggtaaataaacctattattaaagaatctagatcaatgtccaaaaagattatttccattgttacgtctaaatacagattctgcgaaaacaagccattagtatagtagaagaactaaccatcgtatgtaaaaaaaaaaaaaaaaaaaaaaaaaaaaaa

SEQ ID NO: 34 - DNA, 600 bp, Artificial Sequence
  transcript variant
gtgaaaggtgatacatatttacttgacttcttaagcagagagcgtcaaaacaggttgaacttatacagaaatactaaaagtcgaacaaccattcgatttaggagtgcagatacagaacaactaaaagaactaaaagagaagaacgacgtgcacgtgctaattatgcgaattaacatcgggttagaaaaagtaaactaaaggaaaatgggtaaggcatatgccttactaaattgtgtaaaagaagttctaataagaaccggaatgtatgtaattattcgcaagggttccataaggcacatatacaaatttagaaacaacccgttacattaacaaaggtgaacggtgtttcacagatattagaccattaggtaaccaatgacatttcactatcgaaaagggtataggaggacatgcacctagttgaacacgactaggaggacgatggccactacggagtggaacacaaaggtaaagttgcaataataaccagtacaacaaaagcatacgtggaaggtgacaagcaaacgatgtcttgaacaacaccgtcttcattgtttaccatttgctgttaaaaaaaaaaaaaaaaaaaaaaaaaaaaaa

SEQ ID NO: 35 - DNA, 1597 bp, Artificial Sequence
  transcript variant
gtgtagcatagcaactgttctgaatgtgatattcggtcaggccacgttgacacttaccaaagcaagacagaaggaagttgacgggacaatagggaagattggcaaagggatttaaacatagtccagttcgcgtggtgaatgacagattgctactgttaccattggcgatactacgttggcgactttacttgcctcggtagcgacagaacaagtgtcgtctacgcaacgaacaaccagcgtgttagctgcaatgtcccctgtagaagaccctcttctttctcttctgaatgatgtagctgtggatagagcgtctcccacgttagggtctagcaaccctccggtggtgtgtggtttcggttcgcttggttgggtgcccaatttccagtaccgaagaggtaattgcaacttcaattgcttagttgacgtgacctttcgggtgtcatggactaccgacggtatctcatacgtgacctcgttgttgacctcgttcttcatctgcacagactacaacgttaggactacggaaccagtgtgaagttgacggacgcgctagaagtctgacactgaccatgcttgtggcaatcgttgttcatgtagccactttgactcgacgttcacgaacatacgatggttagttcttctactatactaatggcttgttttcgcagaatctgtatttagacgtaacaatggaaataatctttttggacattgatctagattctttaataataggtttatttaccaagttgacgtttcacaagttgttttaaaccgactttttttgatgtgtttgtagttattacagctgaaagatgacgcgtactagagccgcggcgtgtcaaactttgcatgccagtcgcgacagcgagtcaggttaagactagcctatgttaatttgcacatgctaacataagtcaataactttaaccgtcttctttatatgttgttgctgcatgattatctgtaaccactatctagttaataatatggttgtaacagtgtctgttacagtcaccatggattttgttgttatggatttggctgttgacacagctgtagcctatattacgttttttgtttccacggttgttattaatagctaagacttagaaggagcggcgtttgtgtatacggcggtggttatggtggtggttatggcggcggtggcggcggcggagtttgtttgaatagaagctgctatggaggaggcggcagcggaggaggcggtggcagtaatggtaattatcttctatatcattatggtaggtcatttctagcgctaatatgttgcagctgagccgttcaaaattttctaggtgcatggcttaactaccttgtttatgtctttccttaatttaatttttttcatagttttgggcggctaccgccaagctatcatttatggcaatggcggcggcggtcaggatgacgtttctaaaatgttgctgcgtatcggcaagttggctcaggacatcaaagcagtcttagccttttgcccacctggctgctgcttgttgtcgtcgctcggtcgtcgcttaattttgttatacatgctagaaacaggaaaaaaaaaaaaaaaaaaaaaaaaaaaaaa

SEQ ID NO: 36 - DNA, 980 bp, Artificial Sequence
  transcript variant
gatcgtggcccagtcagtggattacgttgaccatgagtctggctgttcttggttcaccattagctgtggtgacaataacgggcattgtggcaacgatacgtcgtactgcaagtcccactgtaactaagacaattcggattcgaccgatacttggtctggttcgttaacttcgcgtaccttctgctttaccagcaggtcgtcaacgacgagccaccgtaacgagtgtggtttcggttcgcttggttgggtgcccaatttccagtaccgaagaggtaattgcaacttcaattgcttagttgacgtgacctttcgggtgtcatggactaccgacggtatctcatacgtgacctcgttgttgacctcgttcttcatctgcacagactacaacgttaggactacggaaccagtgtgaagttgacggacgcgctagtttacagatgcggtttattggattggttacaacggcaaaggcggagaccactccaactgtcggaagagtacctcttcaaattgccattccaattgctcgtcatggactttccactcttagacgacccgatgaagctagaagtctgacactgaccatgcttgtggcaatcgttgttcatgtagccactttgactcgacgttcacgaacatacgatggttagttcttctactatactaatggcttgttttcgcagaatctgtatttagacgtaacaatggaaataatctttttggacattgatctagattctttaataataggtttatttaccaagttgacgtttcacaagttgttttaaaccgactttttttgatgtgtttgtagttattacagctgaaagatgacgcgtactagagccgcggcgtgtcaaactttgcatgccagtcgcgacagcgagtcaggttaagactagcctatgttaatttgcacatgctaacataagtcaataactttaaccgtcaaaaaaaaaaaaaaaaaaaaaaaaaaaaaa

SEQ ID NO: 37 - DNA, 1920 bp, Artificial Sequence
  transcript variant
gtagacctttccttgccgcgtggaacaaaccgccatgagtgttttacgtttacggtcggcgaccggagtcacagcgcgaccaacggggccaggcaaaggcccataggcttttccatcggcacgcgaccgattccatcaagtgttaggtgcaatccccattcgggacggacacgcgagtaaaggtctaacatgtttcaactttccagttagtcgccgtcctatattggcaagaccggatggccgtcaaccagttccattctgactatttgccacattgattaaagaagtaggagcgttagtcggcgcgtgcgcgggactatttagcgaaggtcgccgatcgtttgcccgtaaaactaactggcaaaagcctaagtgctgtttcgggtgcaatggtataacttcccacatttagccgaatagcgccaacagcgttattatttggaaccaagcagtgggcgatgtcagcgacaattccactttggtagaggtcgttcttttgtagaaaacaatctaacataactatgacactttcggtaaattcaccacctttaccagggtcgtaagtggtcaagccacgccgaccacttcataagcattggtggaaatcgcatcgacacaataaaagtacaccaaccagcagaaaacaggtacatatacagtttaacgacctggatctaagatgactacagtagcatagccatagaacatggcactgaaatatcgatgggcgtaaaagtgaacaacgcagacgatggattacgacgccaagccactataaatgctaattgagtcgaagaaggtactcctttttggaacacagatattgcagaagcgggaatgaggttgatattacatcaagtatcaacagacgacctcagaagggtggtcttttaaaatgacaacgtacattaagatgcagacaaacactactatgctggatgtgaaaatgtcatatgtgcggcaaaaatagacgacatttaagaacctagcattataggatggagtgttgtattaattcactctagagtaatggatcacggtgccagaaactaaggtggtgtaggactagatgcaagtaacaacggtcgtactaaaatcagctacgcgatcgccgacttagaaggctgagatggagaaacttgtctactggcagacctcactatcttttaggaaggtcacgaagcggctggagtgatggctagtctcagccactgtcaacgggaagcgcgacgtttatggtcaatataaactagcagtttaatccgtatggcgatcttagcggatgttacaggatggagaagatgacaaagtagaagctagacaactatatcaaatcgttgtgtggtcttaaaccgacacagtagcattcatcgttggatgtggaaggtcacagcctcgttggaggagatactacggtcccgcttttcgtgggtgacaaaggtcgcaaaggtttccttagggaggtcgtttcccggatctttatctacatctcctgggtgaaggggatgatctttctctacatagattgcagagagccaggtcaaatacattgagaaatctgtatatgtactttggtaacgctctaaggtaggtacacgttagtgatataaaaagaaggcgacgacgaacttaaattgttagagcagtttatgggtggtaggttacatctatttacttcaaaacgcggtgccctagcccacaagcattgctttgtaaaattgttgaaggtaacttgtaaaagccgaacatgaacgatggatagtagaccgggaagaccaacgttttttcactactccgaaagaacacactgaagggaacggtgtaggttcggtgagtccgggactaggtgtccatgtcggagacctcagtggtgacgtcctcgtagtatagaaaaaaaaaaaaaaaaaaaaaaaaaaaaaa

SEQ ID NO: 38 - DNA, 2014 bp, Artificial Sequence
  transcript variant
gacttgtaggcccatgaattacccgcttaggcaatgggtagacctttccttgccgcgtggaacaaaccgccatgagtgttttacgtttacggtcggcgaccggagtcacagcgcgaccaacggggccaggcaaaggcccataggcttttccatcggcacgcgaccgattccatcaagtgttaggtgcaatccccattcgggacggacacgcgagagcgttagtcggcgcgtgcgcgggactatttagcgaaggtcgccgtatcgcgggtggcggcgtttccgccataacaacaagcgtttaaggtcagagtccgcgacgaatgaaacgccgtgcaagcggctttggtacggccagtttagccaaagcctgatccgttcgccttgggttatcatgtaccagtcaagcggtcatcgcgggcggcgttatcatggatcgtttgcccgtaaaactaactggcaaaagcctaagtgctgtttcgggtgcaatggtataacttcccacatttagccgaatagcgccaacagcgttattatttggaaccaagcagtgggcgatgtcagcgacaattccactttggtagaggtcgttcttttgtagaaaacaatctaacataactatgacactttcggtaaattcaccacctttaccagggtcgtaagtggtcaagccacgccgaccacttcataagcattggtggaaatcgcatcgacacaataaaagtacaccaaccagcagaaaacaggtacatatacagtttaacgacctggatctaagatgactacagtagcatagccatagaacatggcactgaaatatcgatgggcgtaaaagtgaacaacgcagacgatggattacgacgccaagccactataaatgctaattgagtcgaagaaggtactcctttttggaacacagatattgcagaagcgggaatgaggttgatattacatcaagtatcaacagacgacctcagaagggtggtcttttaaaatgacaacgtacattaagatgcagacaaacactactatgctggatgtgaaaatgtcatatgtgcggcaaaaatagacgacatttaagaacctagcattataggatggagtgttgtattaattcactctagagtaatggatcacggtgccagaaactaaggtggtgtaggactagatgcaagtaacaacggtcgtactaaaatcagctacgcgatcgccgacttagaaggctgagatggagaaacttgtctactggcagacctcactatcttttaggaaggtcacgaagcggctggagtgatggctagtctcagccactgtcaacgggaagcgcgacgtttatggtcaatataaactagcagtttaatccgtatggcgatcttagcggatgttacaggatggagaagatgacaaagtagaagctagacaactatatcaaatcgttgtgtggtcttaaaccgacacagtagcattcatcgttggatgtggaaggtcacagcctcgttggaggagatactacggtcccgcttttcgtgggtgacaaaggtcgcaaaggtttccttagggaggtcgtttcccggatctttatctacatctcctgggtgaaggggatgatctttctctacatagattgcagagagccaggtcaaatacattgagaaatctgtatatgtactttggtaacgctctaaggtaggtacacgttagtgatataaaaagaaggcgacgacgaacttaaattgttagagcagtttatgggtggtaggttacatctatttacttcaaaacgcggtgccctagcccacaagcattgctttgtaaaattgttgaaggtaacttgtaaaagccgaacatgaacgatggatagtagaccgggaagaccaacgttttttcactactccgaaagaacacactgaagggaacggtgtaggttcggtgagtccgggactaggtgtccatgtcggagacctcagtggtgacgtcctcgtagtataaaaaaaaaaaaaaaaaaaaaaaaaaaaaa

SEQ ID NO: 39 - DNA, 556 bp, Artificial Sequence
  transcript variant
gtcacctaaacgtgcgaagtgtgcgaaattaccaccgtaaattcgtcctactgaaagtgcttacgcatcttgagagagattgcagagagccaggtcaaatacattgagaaatctgtatatgtactttggtaacgctctaaggtaggtacacgttagtgatataaaaagaaggcgacgacggtagcagaggtctagaaaccgcatgaacgaccaacttatttgaagagctagtgcggtggaattgggtcggaagaacttaaattgttagagcagtttatgggtggtaggttacatctatttacttcaaaacgcggtgccctagcccacaagcattgctttgtaaaattgttgaaggtaacttgtaaaagccgaacatgaacgatggatagtagaccgggaagaccaacgttttttcactactccgaaagaacacactgaagggaacggtgtaggttcggtgagtccgggactaggtgtccatgtcggagacctcagtggtgacgtcctcgtagtataggtccacgctaaaaaaaaaaaaaaaaaaaaaaaaaaaaaa

SEQ ID NO: 40 - DNA, 2503 bp, Artificial Sequence
  transcript variant
gtccacgctctaagtcgcttgcccaattgtggctaccgcattgctcagaacttcgggtactggccaaccttcaagaagcctagtcttggtgcgtcaccccagtcacgtagcatacccgtcatcatctatggtcgtaggtccaacaatcgtggcgccattgggtaccacttcatcagagctgctcgcatgaccagctatatctggaacatcgctggtgggtcttatggtcgcttttgtgggaaccatcatagtcgcaagtctggccttcggtatggaactcgtcgtcccgactacaaccatagctagtctcggtctcggctttgttgcaatgcccttcgttactacttcaacggtcgtggtgccggtcaaaccgctcgctaaagcaagcgaagaaacagctaaacttagttgtgtcgaaacatcctaagtggtcgggttgctcgtggagcatgcagctagcccagaacctttagcttgtgtggtcttcgtctcggtagtcagaaccaggtcggtctgaatggttggactcgccacatcaactaggtcagctattgaagtgccaactaaaggtcgtattgaagcaatcggtcctatggcaagtcaagtgacagtcgtaggtatggcacttgccgcgcctccagaactcggtcaagctacctcataactcggaagtcgactgctctaaagcgaagttgtcaaacgaacagctatgccttcgagtaaagcaaggtgcgcaatagtaaccttggtaacttcggaactgcgtcaagccgctaactccatcggtatggaagtcgctaaagtcggtcaaacggaagcggctatcgtcgcaactagtcgaatagttgtcgaagaggccagagcaaccatggttgccattgtcttcgtggtctatgcaagacgtccttgcgtcatggcctaagcatcttcttcactggttgctatagcggaagtcgttaccgaactggtcgccagtcgaatcgtttgccccatggtagtcatcaccaccatcgcggaaaccaacggtccgaactcacggtaggtagtccacgtatgtagcccacctttcgaaggaatcgtggtcgccggtctcctagaaacggtatatgtcttgcgtcacgcttatggaccggtcatcctggccagtagccgacttgtggtcgctatagctttcgctagtccctgccttaacgtgcagcatggtatggctattgtcgtcccggctacaaccactatcgtggtcttgaaactggtcgtcgctacaaccatcctagcattggcaccagcggtcgttgaagccgaaggtagtctctaactggttttcgaagctagtcaaacagtagcgccatatggcctagcctgaaccttagaaaaaggagtcgaaggtcctaaacccgctggtcgcgaacgaacaaaaacggtcgttaaaggccgtccggaagcggaaggtcgtcgccccaggtgaacaagtcctaaagaaacaaaaagtctctgtagtctatttaaaacccaacgcaaacgcgaacgcagaatcgtctgaacccacgtccatcattacggattatataaggtttctgtttcgttaactaggtagttattgatgtcatccgcactacaagctaacaggaggtaacagatagagcatgagtggtagtagggatgaaacaggaagtactaattacatacagggactcctggttgggtgaccccgggacacgtacgtgtcctaataaacaggaggcgggtggtttcctatctactacggacagggattttccccgagtagcgaaggatatgaaacttctagttatagacatataagacgtagtccaggaagtcggctgagtccatgaggtcagttttggaggagaagtagttgtcacgatccttagttaagataacaaagtccgagtagttatcacgacttgctgactgcgtccactatgtttccggggtgggcatggggacttgcacacggataactccatccggattattaagacgaggtggggtgtgctgggctcccaggaacttcatcggagtgacgtagaaccttcagtttgagtccacgtaggacaccagcgctattggtgccgacgacgagtacaaacatccggaaacttagcatattaggtaagagtttctgtatgctcggacgtcgtcgttagagcagacccagaaggtgtccatggacacacatcatacaagacaacttggtcaacttttacggggctggggccaattatcccgggagtcctcacgatcagaaaccgactggtttgtcacactctggttagaggaggggtcaccacgatgggtgagggggtggtgggtgtttatacaagagtctgggactccaaagacgatattacgacgagacgacttatccacgtactttgtttcccaaacccacgcaactccacctttagtccacacaaactagtacgagacacccggattcaaggtcgtgaccaaaaaaaaaaaaaaaaaaaaaaaaaaaaaa

SEQ ID NO: 41 - DNA, 2059 bp, Artificial Sequence
  transcript variant
ggaccgaagcatactgcaagacttgtaggcccatgaattacccgcttaggcaatgggtagacctttccttgccgcgtggaacaaaccgccatgagtgttttacgtttacggtcggcgaccggagtcacagcgcgaccaacggggccaggcaaaggcccataggcttttccatcggcacgcgaccgattccatcaagtgttaggtgcaatccccattcgggacggacacgcgagagcgttagtcggcgcgtgcgcgggactatttagcgaaggtcgccgatcgtttgcccgtaaaactaactggcaaaagcctaagtgctgtttcgggtgcaatggtataacttcccacatttagccgaatagcgccaacagcgttattatttggaaccaagcagtgggcgatgtcagcgacaattccactttggtagaggtcgttcttttgtagaaaacaatctaacataactatgacactttcggtaaattcaccacctttaccagggtcgtaagtggtcaagccacgccgaccacttcataagcattggtggaaatcgcatcgacacaataaaagtacaccaaccagcagaaaacaggtacatatacagtttaacgacctggatctaagatgactacagtagcatagccatagaacatggcactgaaatatcgatgggcgtaaaagtgaacaacgcagacgatggattacgacgccaagccactataaatgctaattgagtcgaagaaggtactcctttttggaacacagatattgcagaagcgggaatgaggttgatattacatcaagtatcaacagacgacctcagaagggtggtcttttaaaatgacaacgtacattaagatgcagacaaacactactatgctggagtgttgtattaattcactctagagtaatggatcacggtgccagaaactaaggtggtgtaggactagatgcaagtaacaacggtcgtactaaaatcagctacgcgatcgccgacttagaaggctgagatggagaaacttgtctactggcagacctcactatcttttaggaaggtcacgaagcggctggagtgatggctagtctcagccactgtcaacgggaagcgcgacgtttatggtcaatataaactagcagtttaatccgtatggcgatcttagcggatgttacaggatggagaagatgacaaagtagaagctagacaactatatcaaatcgttgtgtggtcttaaaccgacacagtagcattcatcgttggatgtggaaggtcacagcctcgttggaggagatactacggtcccgcttttcgtgggtgacaaaggtcgcaaaggtttccttagggaggtcgtttcccggatctttatctacatctcctgggtgaaggggatgatctttctctacatgtcctgggtggaggggagtttccttgtatgggtggaacccaacccgccggtgagggtgagttacggtcggcggtcatatgtgggtatgacgggtatgacgtcataaatagtcgttgtcaaaatgggaggtggaagtccttactgtagtcacccgtgaaggtggagaactggcaggacatctctaggtcacctaaacgtgcgaagtgtgcgaaattaccaccgtaaattcgtcctactgaaagtgcttacgcatcttgagagagattgcagagagccaggtcaaatacattgagaaatctgtatatgtactttggtaacgctctaaggtaggtacacgttagtgatataaaaagaaggcgacgacgaacttaaattgttagagcagtttatgggtggtaggttacatctatttacttcaaaacgcggtgccctagcccacaagcattgctttgtaaaattgttgaaggtaacttgtaaaagccgaacatgaacgatggatagtagaccgggaagaccaacgttttttcactactccgaaagaacacactgaagggaacggtgtaggttcggtgagtccgggactaggtgtccatgtcggagacctcagtggtgacgtcctcgtagtatagaaaaaaaaaaaaaaaaaaaaaaaaaaaaaa

SEQ ID NO: 42 - DNA, 582 bp, Artificial Sequence
  transcript variant
gcatactgcaagacttgtaggcccatgaattacccgcttaggcaatgggtagacctttccttgccgcgtggaacaaaccgccatgagtgttttacgtttacggtcggcgaccggagtcacagcgcgaccaacggggccaggcaaaggcccataggcttttccatcggcacgcgaccgattccatcaagtatagccacggtcgtaacttcgacggcggcaatagtttatggcgctaacacctttccatcgctgagtccaaacgtatgacgtgaggtgttaggtgcaatccccattcgggacggacacgcgagtaaaggtctaacatgtttcaactttccagttagtcgccgtcctatattggcaagaccggatggccgtcaaccagttccattctgactatttgccacattgattaaagaagtaggagcgttagtcggcgcgtgcgcgggactatttagcgaaggtcgccgtatcgcgggtggcggcgtttccgccataacaacaagcgtttaaggtcagagtccgcgacgaatgaaacgccgtgcaagcggcaaaaaaaaaaaaaaaaaaaaaaaaaaaaaa

SEQ ID NO: 43 - DNA, 563 bp, Artificial Sequence
  transcript variant
ggcccatgaattacccgcttaggcaatgggtagacctttccttgccgcgtggaacaaaccgccatgagtgttttacgtttacggtcggcgaccggagtcacagcgcgaccaacggggccagggaggaagccttttagccatcgctatgccgccgctcaaacgcgccgggtgcaaaagcccagagcaaaggcccataggcttttccatcggcacgcgaccgattccatcaagtgttaggtgcaatccccattcgggacggacacgcgagagcgttagtcggcgcgtgcgcgggactatttagcgaaggtcgccgatcgtttgcccgtaaaactaactggcaaaagcctaagtgctgtttcgggtgcaatggtataacttcccacatttagccgaatagcgccaacagcgttattatttggaaccaagcagtgggcgatgtcagcgacaattccactttggtagaggtcgttcttttgtagaaaacaatctaacataactatgacactttcggtaaattcaccacctttaccaggaaaaaaaaaaaaaaaaaaaaaaaaaaaaaa

SEQ ID NO: 44 - DNA, 2115 bp, Artificial Sequence
  transcript variant
gcatactgcaagacttgtaggcccatgaattacccgcttaggcaatgggtagacctttccttgccgcgtggaacaaaccgccatgagtgttttacgtttacggtcggcgaccggagtcacagcgcgaccaacggggccaggcaaaggcccataggcttttccatcggcacgcgaccgattccatcaagtgttaggtgcaatccccattcgggacggacacgcgagagcgttagtcggcgcgtgcgcgggactatttagcgaaggtcgccgatcgtttgcccgtaaaactaactggcaaaagcctaagtgctgtttcgggtgcaatggtataacttcccacatttagccgaatagcgccaacagcgttattatttggaaccaagcagtgggcgatgtcagcgacaattccactttggtagaggtcgttcttttgtagaaaacaatctaacataactatgacactttcggtaaattcaccacctttaccagggtcgtaagtggtcaagccacgccgaccacttcataagcattggtggaaatcgcatcgacacaataaaagtacaccaaccagcagaaaacaggtacatatacagtttaacgacctggatctaagatgactacagtagcatagccatagaacatggcactgaaatatcgatgggcgtaaaagtgaacaacgcagacgatggattacgacgccaagccactataaatgctaattgagtcgaagaaggtactcctttttggaacacagatattgcagaagcgggaatgaggttgatattacatcaagtatcaacagacgacctcagaagggtggtcttttaaaatgacaacgtacattaagatgcagacaaacactactatgctggatgtgaaaatgtcatatgtgcggcaaaaatagacgacatttaagaacctagcattataggatggagtgttgtattaattcactctagagtaatggatcacggtgccagaaactaaggtggtgtaggactagatgcaagtaacaacggtcgtactaaaatcagctacgcgatcgccgacttagaaggctgagatggagaaacttgtctactggcagacctcactatcttttaggaaggtcacgaagcggctggagtgatggctagtctcagccactgtcaacgggaagcgcgacgtttatggtcaatataaactagcagtttaatccgtatggcgatcttagcggatgttacaggatggagaagatgacaaagtagaagctagacaactatatcaaatcgttgtgtggtcttaaaccgacacagtagcattcatcgttggatgtggaaggtcacagcctcgttggaggagatactacggtcccgcttttcgtgggtgacaaaggtcgcaaaggtttccttagggaggtcgtttcccggatctttatctacatctcctgggtgaaggggatgatctttctctacatgtcctgggtggaggggagtttccttgtatgggtggaacccaacccgccggtgagggtgagttacggtcggcggtcatatgtgggtatgacgggtatgacgtcataaatagtcgttgtcaaaatgggaggtggaagtccttactgtagtcacccgtgaaggtggagaactggcaggacatctctaggtcacctaaacgtgcgaagtgtgcgaaattaccaccgtaaattcgtcctactgaaagtgcttacgcatcttgagagagattgcagagagccaggtcaaatacattgagaaatctgtatatgtactttggtaacgctctaaggtaggtacacgttagtgatataaaaagaaggcgacgacgaacttaaattgttagagcagtttatgggtggtaggttacatctatttacttcaaaacgcggtgccctagcccacaagcattgctttgtaaaattgttgaaggtaacttgtaaaagccgaacatgaacgatggatagtagaccgggaagaccaacgttttttcactactccgaaagaacacactgaagggaacggtgtaggttcggtgagtccgggactaggtgtccatgtcggagacctcagtggtgacgtcctcgtagtatagaaaaaaaaaaaaaaaaaaaaaaaaaaaaaa

SEQ ID NO: 45 - DNA, 915 bp, Artificial Sequence
  transcript variant
gtatatgtactttggtaacgctctaaggtaggtacacgttagtgatataaaaagaaggcgacgacgaacttaaattgttagagcagtttatgggtggtaggttacatctatttacttcaaaacgcggtgccctagcccacaagcattgctttgtaaaattgttgaaggtaacttgtaaaagccgaacatgaacgatggatagtagaccgggaagaccaacgttttttcactactccgaaagaacacactgaagggaacggtgtaggttcggtgagtccgggactaggtgtccatgtcggagacctcagtggtgacgtcctcgtagtatagctgctcgcatgaccagctatatctggaacatcgctggtgggtcttatggtcgcttttgtgggaaccatcatagtcgcaagtctggccttcggtatggaactcgtcgtcccgactacaaccatagctagtctcggtctcggctttgttgcaatgcccttcgttactacttcaacggtcgtggtgccggtcaaaccgctcgctaaagcaagcgaagaaacagctaaacttagttgtgtcgaaacatcctaagtggtcgggttgctcgtggagcatgcagctagcccagaacctttagcttgtgtggtcttcgtctcggtagtcagaaccaggtcggtctgaatggttggactcgccacatcaactaggtcagctattgaagtgccaactaaaggtcgtattgaagcaatcggtcctatggcaagtcaagtgacagtcgtaggtatggcacttgccgcgcctccagaactcggtcaagctacctcataactcggaagtcgactgctctaaagcgaagttgtcaaacgaacagctatgccttcgagtaaagcaaggtgcaaaaaaaaaaaaaaaaaaaaaaaaaaaaaa

SEQ ID NO: 46 - DNA, 2504 bp, Artificial Sequence
  transcript variant
gcccatgaattacccgcttaggcaatgggtagacctttccttgccgcgtggaacaaaccgccatgagtgttttacgtttacggtcggcgaccggagtcacagcgcgaccaacggggccaggcaaaggcccataggcttttccatcggcacgcgaccgattccatcaagtgttaggtgcaatccccattcgggacggacacgcgagagcgttagtcggcgcgtgcgcgggactatttagcgaaggtcgccgatcgtttgcccgtaaaactaactggcaaaagcctaagtgctgtttcgggtgcaatggtataacttcccacatttagccgaatagcgccaacagcgttattatttggaaccaagcagtgggcgatgtcagcgacaattccactttggtagaggtcgttcttttgtagaaaacaatctaacataactatgacactttcggtaaattcaccacctttaccagggtcgtaagtggtcaagccacgccgaccacttcataagcattggtggaaatcgcatcgacacaataaaagtacaccaaccagcagaaaacaggtacatatacagtttaacgacctggatctaagatgactacagtagcatagccatagaacatggcactgaaatatcgatgggcgtaaaagtgaacaacgcagacgatggattacgacgccaagccactataaatgctaattgagtcgaagaaggtactcctttttggaacacagatattgcagaagcgggaatgaggttgatattacatcaagtatcaacagacgacctcagaagggtggtcttttaaaatgacaacgtacattaagatgcagacaaacactactatgctggagtgttgtattaattcactctagagtaatggatcacggtgccagaaactaaggtggtgtaggactagatgcaagtaacaacggtcgtactaaaatcagctacgcgatcgccgacttagaaggctgagatggagaaacttgtctactggcagacctcactatcttttaggaaggtcacgaagcggctggagtgatggctagtctcagccactgtcaacgggaagcgcgacgtttatggtcaatataaactagcagtttaatccgtatggcgatcttagcggatgttacaggatggagaagatgacaaagtagaagctagacaactatatcaaatcgttgtgtggtcttaaaccgacacagtagcattcatcgttggatgtggaaggtcacagcctcgttggaggagatactacggtcccgcttttcgtgggtgacaaaggtcgcaaaggtttccttagggaggtcgtttcccggatctttatctacatctcctgggtgaaggggatgatctttctctacatagattgcagagagccaggtcaaatacattgagaaatctgtatatgtactttggtaacgctctaaggtaggtacacgttagtgatataaaaagaaggcgacgacgaacttaaattgttagagcagtttatgggtggtaggttacatctatttacttcaaaacgcggtgccctagcccacaagcattgctttgtaaaattgttgaaggtaacttgtaaaagccgaacatgaacgatggatagtagaccgggaagaccaacgttttttcactactccgaaagaacacactgaagggaacggtgtaggttcggtgagtccgggactaggtgtccatgtcggagacctcagtggtgacgtcctcgtagtataggtccacgctctaagtcgcttgcccaattgtggctaccgcattgctcagaacttcgggtactggccaaccttcaagaagcctagtcttggtgcgtcaccccagtcacgtagcatacccgtcatcatctatggtcgtaggtccaacaatcgtggcgccattgggtaccacttcatcagagctgctcgcatgaccagctatatctggaacatcgctggtgggtcttatggtcgcttttgtgggaaccatcatagtcgcaagtctggccttcggtatggaactcgtcgtcccgactacaaccatagctagtctcggtctcggctttgttgcaatgcccttcgttactacttcaacggtcgtggtgccggtcaaaccgctcgctaaagcaagcgaagaaacagctaaacttagttgtgtcgaaacatcctaagtggtcgggttgctcgtggagcatgcagctagcccagaacctttagcttgtgtggtcttcgtctcggtagtcagaaccaggtcggtctgaatggttggactcgccacatcaactaggtcagctattgaagtgccaactaaaggtcgtattgaagcaatcggtcctatggcaagtcaagtgacagtcgtaggtatggcacttgccgcgcctccagaactcggtcaagctacctcataactcggaagtcgactgctctaaagcgaagttgtcaaacgaacagctatgccttcgagtaaagcaaggtgcgaaaaaaaaaaaaaaaaaaaaaaaaaaaaaa

SEQ ID NO: 47 - DNA, 576 bp, Artificial Sequence
  transcript variant
gcatactgcaagacttgtaggcccatgaattacccgcttaggcaatgggtagacctttccttgccgcgtggaacaaaccgccatgagtgttttacgtttacggtcggcgaccggagtcacagcgcgaccaacgggcaaaggcccataggcttttccatcggcacgcgaccgattccatcaagtatagccacggtcgtaacttcgacggcggcaatagtttatggcgctaacacctttccatcgctgagtccaaacgtatgacgtgaggtgttaggtgcaatccccattcgggacggacacgcgagtaaaggtctaacatgtttcaactttccagttagtcgccgtcctatattggcaagaccggatggccgtcaaccagttccattctgactatttgccacattgattaaagaagtaggagcgttagtcggcgcgtgcgcgggactatttagcgaaggtcgccgtatcgcgggtggcggcgtttccgccataacaacaagcgtttaaggtcagagtccgcgacgaatgaaacgccgtgcaagcggcaaaaaaaaaaaaaaaaaaaaaaaaaaaaaa

SEQ ID NO: 48 - DNA, 259 bp, Artificial Sequence
  transcript variant
gtaccaaagccgcttgcacggcgtttcattcgtcgcggactctgaccttaaacgcttgttgttatggcggaaacgccgccacccgcgatacggcgaccttcgctaaatagtcccgcgcacgcgccgactaacgctcctacttctttaatcaatgtggcaaatagtcagaatggaactggttgacggccatccggtcttgccaatataggacggcgactaactggaaagtaaaaaaaaaaaaaaaaaaaaaaaaaaaaaa

SEQ ID NO: 49 - DNA, 1465 bp, Artificial Sequence
  transcript variant
ggcaagacgaatctgcgtcaacgctaaaggccgtcaaaaagcaagagggcgtcgcgcctgggaaaaaggtagtcaagaaaccatcaagcttaaatgtcgggaaattgggtttgcgccgccttcaggggcagcgatgggggcgacaattgtggaccgtatggactccattatgctgggactcctcgggtcaaccgctctaaagcgaagttgttggacaaacagttatgcgtaactgtaaagcaaggtgcccaaagtagactgagcgacagtcgaaaccagccccaatgaacaagacgccattgcaaaacgtctatacgctacggtcaaagacgcttccacaccacatgttgtgctcgccatttcaactagtgcagttgctaaagtgccaactaaggttcgtcttgaagcaatcggtagtatctgcagtcaagtcgtagtcgtaggtatggcacttgtcgtgcgtctaggacgcgttgaagctatcttattgcccgaaggagccgaaagtctgggacacgtcgtgggacgtatcgttaggactatgggactagtcgtcttcggtcttacaaatgttgcaatgccctgtgagctacttatgaaacatgaatggtcggtcttgtggtcgcttttgtcgaaatcaccgaagtgcgtataattgatgaacgagtcgaagtcgaagttgttcaacaagagagttaggtagtgccgcttgaaaaagtaatagtgcaaataagaaaaagaagcgaaacggcattcgtttaacaaaacgtcacatatttaggtatagtagattgcgttcacaaagaaatttaaatttaatttaccatttcgtcattgtatatgcggtaaacgtaaatttacacatatgacacgaactttgagttttattagcctgcctaattgttggtaacaatgtaatggaaattggcgatgactatggggaaagagcaatcaactcaccataaatttgtgaacgcagttaagtaattggcatcgcgcgcctaatcgtttacattcgcatggaacaagaagaaagagacctattcgtgggagtcaatggctatgtggaaaaacatgaactgccaaattcggctaaccaaccagaaatggtcatggaaaattcttgcgtcaaagttcgcggtgacgtttacgaagaagctaaacttgtgcttgtttagaaagttaggtgcgtcctggttttagtaaatttagaaaaccattttgttgtttgcgacagttaaataaaacttaacgacaaagaagtgacttgcgtcgtagattaactggaaattaaagtggtatctaaaatggggtttgccgatgcggtcttcaaagtctaaaattcttgaagtttgcgtttggtcgcaaaaattatggatttagtcgattattgcctactaagcagcagtttagaagtttttaagatagttacgctaaaaaaaaaaaaaaaaaaaaaaaaaaaaaa

SEQ ID NO: 50 - DNA, 604 bp, Artificial Sequence
  transcript variant
ggggcagcgatgggggcgacaattgtggaccgtatggactccattatgctgggactcctcgggtcaaccgctctaaagcgaagttgttggacaaacagttatgcgtaactgtaaagcaaggtgcccaaagtagactgagcgacagtcgaaaccagccccaatgaacaagacgccattgcaaaacgtctatacgctacggtcaaagacgcttccacaccacatggactatgggactagtcgtcttcggtcttacaaatgttgcaatgccctgtgagctacttatgaaacatgaatggtcggtcttgtggtcgcttttgtcgaaatcaccgaagtgcgtataattgatgaacgagtcgaagtcgaagttgttcaacaagagagttaggtagtgccgcttgaaaaagtaatagtgcaaataagaaaaagaagcgaaacggcattcgtttaacaaaacgtcacatatttaggtatagtagattgcgttcacaaagaaatttaaatttaatttaccatttcgtcattgtatatgcggtaaacgtaaatttacacatatgacacgaactttgagttttataaaaaaaaaaaaaaaaaaaaaaaaaaaaaa

SEQ ID NO: 51 - DNA, 1999 bp, Artificial Sequence
  transcript variant
gtgggtttatatcgcgtatccatccaacttaactgaaacgcgaagcagtagacagtgttgatcgagatttgcgaagggaaacagtaaaagtccagggtgtcgttaattacgacaaaactaaagactgtatagttagaaggatcaattgggctgatttagaaatggtataagttaaagaaatggaaacttattcgacaaaaagaaaaactcatgatgtatagatggaaactgccataatgtcgattcgagttatatttttagattttggtaaaatatccaacatgtattaacgaaattttgaagtatagatcaaactattcttcaggtacagcatcaagcattcggtagcataagccaaacaagtctttgaagggttggacatagcgagttgtgtagaaagttacgaagacttcaacagaaaaagagtttaaaaggaccacgtatgccaaatcgacaacaatatagtcgttctattctgcgatatgtaagatagagacacatcggcaggtagcatagaacttgggtcaattattatttaagtgcggtaacaaacaaacttagggaatattattgtgctacagcaaatgccttgaaaagtcgagaaagactactatactcgtcaagttcgtaaagacttaacagtaattgtaatgcaaatacttagcgagattgattccttcccagtagtcatctttcctttagatattagaacagcaattttagattttgtacatagtggagaaaaggacgtcattttaatggatgaaccagacgttaacgtcatttacttggtcgttgatttcgaagactcagtcatcaaaattgtagcttcgctagctaatgtgcttaaaatcatcatagtcaaagtgtacgtggtcgtggtaataaacaaccttcattactgtacaaaagtgccagtttgttacattatcgaacgctgtatagaggtatcatttcacctatttgacaactaggtgataaaccttcggtcgctagacgttgttgttattgaaaaaatggaagataatctatacttaatccaaaacaacccagaccaagctcgtatataaatggaagtcgtcaaaattggtttcgttcaaataagttgggactgatgaatcagttttctgaacttcaccgctattagcgtcctagttgtctacataattagtatcattattgtagtagtttaaatcgctaacaaccaaaaaatccttgacatgggtaacgacgttattggggaaccaatgctcagtgttggtgaaagaatcgttaggtcgaactattggtacgttctaataaaagacgacatagaaattcgttacataatcaacgtcactactaagggcgtattgcaaattagttcataaattattaacagtttgcacctaatagttctagtccttaaaaaggtagaagacgtaggtaatgtcagttgcctcaatgtagtcaggtaaaaagtatatgtgctgatggcaaacttcatctttgtgagagttgagcatgtataacaacatcactcagtataaccgcttggttacacaattagtatcatgcctatagaacgccttatcattcaggtcgtcgtgatagtgaaggggatcaaagtcaaaatctactttgtcataactctttacggtatcccaatgcttggtataagtgcttaagaaattgtttaaacagaaactcaagtataagcgaaaacaagttacctggaaaaagaagaagtgcgtataattgatgaacgagtcgaagtcgaagttgttcaacaagagagttaggtagtgccgcttgaaaaagtaatagtgcaaataagaaagtaagactgtatcggagacgactttttaatagtagtaattctcggtacaactaaaccagtaatttcagacactgaaatagaggacttcgttaggtacgaagcaagttaactaaatgacaattaaattgagggtaaatatcacaaagaaataaaaaaaaaaaaaaaaaaaaaaaaaaaaaa

SEQ ID NO: 52 - DNA, 1567 bp, Artificial Sequence
  transcript variant
gcttaaatgtcgggaaattgggtttgcgccgccttcaggggcagcgatgggggcgacaattgtggaccgtatggactccattatgctgggactcctcgggtcaaccgctctaaagcgaagttgttggacaaacagttatgcgtaactgtaaagcaaggtgcccaaagtagactgagcgacagtcgaaaccagccccaatgaacaagacgccattgcaaaacgtctatacgctacggtcaaagacgcttccacaccacatgctctcatgtagcctaccttacgaagaaatcgcacaagtcggtcgcccagcggtggcatatgtcttgcctaacgtttctagaccgatcagcctcacgagtagcctgcttgtggtgtttatagtttacgctagtccaatctgtatcgtgccgcttggtatggctattgtcggcctggatgcaattgtgctcgccatttcaactagtgcagttgctaaagtgccaactaaggttcgtcttgaagcaatcggtagtatctgcagtcaagtcgtagtcgtaggtatggcacttgtcgtgcgtctaggacgcgttgaagctatcttattgcccgaaggagccgaaagtctgggacacgtcgtgggacgtatcgttaggactatgggactagtcgtcttcggtcttacaaatgttgcaatgccctgtgagctacttatgaaacatgaatggtcggtcttgtggtcgcttttgtcgaaatcaccgaagtgcgtataattgatgaacgagtcgaagtcgaagttgttcaacaagagagttaggtagtgccgcttgaaaaagtaatagtgcaaataagaaaaagcgaaacggcattcgtttaacaaaacgtcacatatttaggtatagtagattgcgttcacaaagaaatttaaatttaatttaccatttcgtcattgtatatgcggtaaacgtaaatttacacatatgacacgaactttgagttttattagcctgcctaattgttggtaacaatgtaatggaaattggcgatgactatggggaaagagcaatcaactcaccataaatttgtgaacgcagttaagtaattggcatcgcgcgcctaatcgtttacattcgcatggaacaagaagaaagagacctattcgtgggagtcaatggctatgtggaaaaacatgaactgccaaattcggctaaccaaccagaaatggtcatggaaaattcttgcgtcaaagttcgcggtgacgtttacgaagaagctaaacttgtgcttgtttagaaagttaggtgcgtcctggttttagtaaatttagaaaaccattttgttgtttgcgacagttaaataaaacttaacgacaaagaagtgacttgcgtcgtagattaactggaaattaaagtggtatctaaaatggggtttgccgatgcggtcttcaaagtctaaaattcttgaagtttgcgtttggtcgcaaaaattatggatttagtcgattattgcctactaagcagcagtttagaagtttttaagatagttacgctagaagaccgggaaaaaaaaaaaaaaaaaaaaaaaaaaaaaa

SEQ ID NO: 53 - DNA, 1118 bp, Artificial Sequence
  transcript variant
gcgatgggggcgacaattgtggaccgtatggactccattatgctgggactcctcgggtcaaccgctctaaagcgaagttgttggacaaacagttatgcgtaactgtaaagcaaggtgcccaaagtagactgagcgacagtcgaaaccagccccaatgaacaagacgccattgcaaaacgtctatacgctacggtcaaagacgcttccacaccacatgctctcatgtagcctaccttacgaagaaatcgcacaagtcggtcgcccagcggtggcatatgtcttgcctaacgtttctagaccgatcagcctcacgagtagcctgcttgtggtgtttatagtttacgctagtccaatctgtatcgtgccgcttggtatggctattgtcggcctggatgcaattgtgctcgccatttcaactagtgcagttgctaaagtgccaactaaggttcgtcttgaagcaatcggtagtatctgcagtcaagtcgtagtcgtaggtatggcacttgtcgtgcgtctaggacgcgttgaagctatcttattgcccgaaggagccgaaagtctgggacacgtcgtgggacgtatcgttaggactatgggactagtcgtcttcggtcttacaaatgttgcaatgccctgtgagctacttatgaaacatgaatggtcggtcttgtggtcgcttttgtcgaaatcaccgaagtgcgtataattgatgaacgagtcgaagtcgaagttgttcaacaagagagttaggtagtgccgcttgaaaaagtaatagtgcaaataagaaaaagaagcgaaacggcattcgtttaacaaaacgtcacatatttaggtatagtagattgcgttcacaaagaaatttaaagtcttgtaattatggtggtcgatttattggtagtatatttggaaatagcatgcaattttggaatggacgaagaacctgacatctgagctattgtaagtttaatttaccatttcgtcattgtatatgcggtaaacgtaaatttacacatatgacacgaactttgagttttattagcctgcctaattgttggtaacaatgtaatggaaattggcgatgactatggaaaaaaaaaaaaaaaaaaaaaaaaaaaaaa

SEQ ID NO: 54 - DNA, 575 bp, Artificial Sequence
  transcript variant
gaatattgtttcaatggtcgtggcgctggtcagactgctcgctaaagtcgtcgaagaaacagctagaccatctattctctgaacttcctaagtggtcgggttggtcgtggcgctcatagttagcccagaacgtccagtttatgtggtggtgatcttggttgccagactcagtatggtcaaaatagttgtgctcgccatttcaactagtgcagttgctaaagtgccaactaaggttcgtcttgaagcaatcggtagtatctgcagtcaagtcgtagtcgtaggtatggcacttgtcgtgcgtctaggacgcgttgaagctatcttattgcccgaaggagccgaaagtctgggacacgtcgtgggacgtatcgttaggactatgggactagtcgtcttcggtcttacaaatgttgcaatgccctgtgagctacttatgaaacatgaatggtcggtcttgtggtcgcttttgtcgaaatcaccgaagtgcgtataattgatgaacgagtcgaagtcgaagttgttcaacaagagagttaggtagtgccaaaaaaaaaaaaaaaaaaaaaaaaaaaaaa

SEQ ID NO: 55 - DNA, 604 bp, Artificial Sequence
  transcript variant
gcgatgggggcgacaattgtggaccgtatggactccattatgctgggactcctcgggtcaaccgctctaaagcgaagttgttggacaaacagttatgcgtaactgtaaagcaaggtgcccaagtagactcttactaatttgggaacgacggaaagtcgctaccttcatcggtatggctttcgctaaagtcggtcaaatggaagaaggtagtcgaagtactgttgaaagagtagactgagcgacagtcgaaaccagccccaatgaacaagacgccattgcaaaacgtctatacgctacggtcaaagacgcttccacaccacatgctctcatgtagcctaccttacgaagaaatcgcacaagtcggtcgcccagcggtggcatatgtcttgcctaacgtttctagaccgatcagcctcacgagtagcctgcttgtggtgtttatagtttacgctagtccaatctgtatcgtgccgcttggtatggctattgtcggcctggatgcaattgtgctcgccatttcaactagtgcagttgctaaagtgccaactaaggttcgtcttgaagcaatcggtagaaaaaaaaaaaaaaaaaaaaaaaaaaaaaa

SEQ ID NO: 56 - DNA, 407 bp, Artificial Sequence
  transcript variant
gcctatgcctcgtatcatctatggtcgtaggtaaagcaatagcggaaacattggatgtgacttcatcaggactgctcgtatagtgagctacttatgaaacatgaatggtcggtcttgtggtcgcttttgtcgaaatcaccgaagtgcgtataattgatgaacgagtcgaagtcgaagttgttcaacaagagagttaggtagtgccgcttgaaaaagtaatagtgcaaataagaaaaagaagcgaaacggcattcgtttaacaaaacgtcacatatttaggtatagtagattgcgttcacaaagaaatttaaatttaatttaccatttcgtcattgtatatgcggtaaacgtaaatttacacatatgacacgaactttaaaaaaaaaaaaaaaaaaaaaaaaaaaaaa

SEQ ID NO: 57 - DNA, 515 bp, Artificial Sequence
  transcript variant
gggcgacaattgtggaccgtatggactccattatgctgggactcctcgggtcaaccgctctaaagcgaagttgttggacaaacagttatgcgtaactgtaaagcaaggtgcccaaagtagactgagcgacagtcgaaaccagccccaatgaacaagacgccattgcaaaacgtctatacgctacggtcaaagacgcttccacaccacatgctctcatgtagcctaccttacgaagaaatcgcacaagtcggtcgcccagcggtggcatatgtcttgcctaacgtttctagaccgatcagcctcacgagtagcctgcttgtggtgtttatagtttacgctagtccaatctgtatcgtgccgcttggtatggctattgtcggcctggatgcaagcactaacgtggtcatcagactggtctgcgctataatctacgcaatagaggcaccagcggtcgttgaagccgaagacgctatttcggtggcttgaaaaaaaaaaaaaaaaaaaaaaaaaaaaaa

SEQ ID NO: 58 - DNA, 1193 bp, Artificial Sequence
  transcript variant
gtgctcgccatttcaactagtgcagttgctaaagtgccaactaaggttcgtcttgaagcaatcggtagtatctgcagtcaagtcgtagtcgtaggtatggcacttgtcgtgcgtctaggacgcgttgaagctatcttattgcccgaaggagccgaaagtctgggacacgtcgtgggacgtatcgttaggactatgggactagtcgtcttcggtcttacaaatgttgcaatgccctgtgagctacttatgaaacatgaatggtcggtcttgtggtcgcttttgtcgaaatcaccgaagtgcgtataattgatgaacgagtcgaagtcgaagttgttcaacaagagagttaggtagtgccgcttgaaaaagtaatagtgcaaataagaaagtaagactgtatcggagacgactttttaatagtagtaattctcggtacaactaaaccagtaatttcagacactgaaatagaggacttcgttaggtacgaagcaagttaactaaatgacaattaaattgagggtaaatatcacaaagaaatcatggaagatttcgaccgaatacaggaaaatttagattaaaggtttgtcgtcgttgaaataagaagaagcgaaacggcattcgtttaacaaaacgtcacatatttaggtatagtagattgcgttcacaaagaaatttaaatttaatttaccatttcgtcattgtatatgcggtaaacgtaaatttacacatatgacacgaactttgagttttattagcctgcctaattgttggtaacaatgtaatggaaattggcgatgactatggggaaagagcaatcaactcaccataaatttgtgaacgcagttaagtaattggcatcgcgcgcctaatcgtttacattcgcatggaacaagaagaaagagacctattcgtgggagtcaatggctatgtggaaaaacatgaactgccaaattcggctaaccaaccagaaatggtcatggaaaattcttgcgtcaaagttcgcggtgacgtttacgaagaagctaaacttgtgcttgtttagaaagttaggtgcgtcctggttttagtaaatttagaaaaccattttgttgtttgcgacagttaaataaaacttaacgacaaagaagtgacttgcgtcgtagattaactggaaattaaagtggaaaaaaaaaaaaaaaaaaaaaaaaaaaaaa

SEQ ID NO: 59 - DNA, 484 bp, Artificial Sequence
  transcript variant
ggtagttgttgaaaaagtaggaatatctagcctagatgtcgtttcaggcgaaggactctaaggtcttaaaatcgttgggtcaaccgctctaaagcgaagttgttggacaaacagttatgcgtaactgtaaagcaaggtgcccaaagtagactgagcgacagtcgaaaccagccccaatgaacaagacgccattgcaaaacgtctatacgctacggtcaaagacgcttccacaccacatggtatagtggacgccgttagcctcatgtgtctcactcaaagaccttgcgtcacggtcatcctctttgtcagcaacgtagaaatctccggtctgtcgataccttgcgtaaagctctcatgtagcctaccttacgaagaaatcgcacaagtcggtcgcccagcggtggcatatgtcttgcctaacgtttctagaccgatcagcctcacgagtagcctgaaaaaaaaaaaaaaaaaaaaaaaaaaaaaa

SEQ ID NO: 60 - DNA, 1558 bp, Artificial Sequence
  transcript variant
gcttaaatgtcgggaaattgggtttgcgccgccttcaggggcagcgatgggggcgacaattgtggaccgtatggactccattatgctgggactcctcgggtcaaccgctctaaagcgaagttgttggacaaacagttatgcgtaactgtaaagcaaggtgcccaaagtagactgagcgacagtcgaaaccagccccaatgaacaagacgccattgcaaaacgtctatacgctacggtcaaagacgcttccacaccacatgctctcatgtagcctaccttacgaagaaatcgcacaagtcggtcgcccagcggtggcatatgtcttgcctaacgtttctagaccgatcagcctcacgagtagcctgcttgtggtgtttatagtttacgctagtccaatctgtatcgtgccgcttggtatggctattgtcggcctggatgcaattgtgctcgccatttcaactagtgcagttgctaaagtgccaactaaggttcgtcttgaagcaatcggtagtatctgcagtcaagtcgtagtcgtaggtatggcacttgtcgtgcgtctaggacgcgttgaagctatcttattgcccgaaggagccgaaagtctgggacacgtcgtgggacgtatcgttaggactatgggactagtcgtcttcggtcttacaaatgttgcaatgccctgtgagctacttatgaaacatgaatggtcggtcttgtggtcgcttttgtcgaaatcaccgaagtgcgtataattgatgaacgagtcgaagtcgaagttgttcaacaagagagttaggtagtgccgcttgaaaaagtaatagtgcaaataagaaaaagaagcgaaacggcattcgtttaacaaaacgtcacatatttaggtatagtagattgcgttcacaaagaaatttaaatttaatttaccatttcgtcattgtatatgcggtaaacgtaaatttacacatatgacacgaactttgagttttattagcctgcctaattgttggtaacaatgtaatggaaattggcgatgactatggggaaagagcaatcaactcaccataaatttgtgaacgcagttaagtaattggcatcgcgcgcctaatcgtttacattcgcatggaacaagaagaaagagacctattcgtgggagtcaatggctatgtggaaaaacatgaactgccaaattcggctaaccaaccagaaatggtcatggaaaattcttgcgtcaaagttcgcggtgacgtttacgaagaagctaaacttgtgcttgtttagaaagttaggtgcgtcctggttttagtaaatttagaaaaccattttgttgtttgcgacagttaaataaaacttaacgacaaagaagtgacttgcgtcgtagattaactggaaattaaagtggtatctaaaatggggtttgccgatgcggtcttcaaagtctaaaattcttgaagtttgcgtttggtcgcaaaaattatggatttagtcgattattgcctactaagcagcagtttagaagtttttaagatagttacgcaaaaaaaaaaaaaaaaaaaaaaaaaaaaaa

SEQ ID NO: 61 - DNA, 1341 bp, Artificial Sequence
  transcript variant
gtgagctacttatgaaacatgaatggtcggtcttgtggtcgcttttgtcgaaatcaccggaaacattaaatcaaagaagtttatcaaccaattagtacagtggcatgttaagtaaaacagaaagaacgccaagtggcaacaaatgacgtaattatttaagcaaaaagcgtaaacgcttacaaaggctatttaaatatcagtaaatcgttggaaattgggtatgtgctgccttcatacgcaaaaatggatgcgacagaaacgagttgtatggcctccactacgctcgcctgccgcggaccctaaacgacagtcgtttgcccaactacggctacggcatcgctcagaacttcgggtcttggcccacctttctgacgcctagtcaacgtgcgtcgcctcagtcttggacaaaaagaagaaatatcaattgcaaaaataactataggtacttctttgaagaaaccaaacgtgagtttctaacacgactaaatccatttgatctttgagaaagtcgaagacgaatgaagtgcgtataattgatgaacgagtcgaagtcgaagttgttcaacaagagagttaggtagtgccgcttgaaaaagtaatagtgcaaataagaaaaagaagcgaaacggcattcgtttaacaaaacgtcacatatttaggtatagtagattgcgttcacaaagaaatttaaatttaatttaccatttcgtcattgtatatgcggtaaacgtaaatttacacatatgacacgaactttgagttttattagcctgcctaattgttggtaacaatgtaatggaaattggcgatgactatggggaaagagcaatcaactcaccataaatttgtgaacgcagttaagtaattggcatcgcgcgcctaatcgtttacattcgcatggaacaagaagaaagagacctattcgtgggagtcaatggctatgtggaaaaacatgaactgccaaattcggctaaccaaccagaaatggtcatggaaaattcttgcgtcaaagttcgcggtgacgtttacgaagaagctaaacttgtgcttgtttagaaagttaggtgcgtcctggttttagtaaatttagaaaaccattttgttgtttgcgacagttaaataaaacttaacgacaaagaagtgacttgcgtcgtagattaactggaaattaaagtggtatctaaaatggggtttgccgatgcggtcttcaaagtctaaaattcttgaagtttgcgtttggtcgcaaaaattatggatttagtcgattattgcctactaagcagcagtttagaagtttttaagatagttacgaaaaaaaaaaaaaaaaaaaaaaaaaaaaaa

SEQ ID NO: 62 - DNA, 489 bp, Artificial Sequence
  transcript variant
ggttcgtcttgaagcaatcggtagtatctgcagtcaagtcgtagtcgtaggtatggcacttgtcgtgcgtctaggacgcgttgaagctatcttattgcccgaaggagccgaaagtctgggacacgtcgtgggacgtatcgttaggactatgggactagtcgtcttcggtcttacaaatgttgcaatgccctgtgagctacttatgaaacatgaatggtcggtcttgtggtcgcttttgtcgaaatcaccggacaaaaagaagaaatatcaattgcaaaaataactataggtacttctttgaagaaaccaaacgtgagtttctaacacgactaaatccatttgatctttgagaaagtcgaagacgaatgaagtgcgtataattgatgaacgagtcgaagtcgaagttgttcaacaagagagttaggtagtgccgcttgaaaaagtaatagtgcaaataagaaaaaaaaaaaaaaaaaaaaaaaaaaaaaa

SEQ ID NO: 63 - DNA, 813 bp, Artificial Sequence
  transcript variant
ggggaaccaatgctcagtgttggtgaaagaatcgttaggtcgaactattggtacgttctaataaaagacgacatagaaattcgttacataatcaacgtcactactaagggcgtattgcaaattagttcataaattattaacagtttgcacctaatagttctagtccttaaaaaggtagaagacgtaggtaatgtcagttgcctcaatgtagtcaggtaaaaagtatatgtgctgatggcaaacttcatctttgtgagagttgagcatgtataacaacatcactcagtataaccgcttggttacacaattagtatcatgcctatagaacgccttatcattcaggtcgtcgtgatagtgaaggggatcaaagtcaaaatctactttgtcataactctttacggtatcccaatgcttggtataagtgcttaagaaattgtttaaacagaaactcaagtataagcgaaaacaagttacctggaaaaagaagaagtgcgtataattgatgaacgagtcgaagtcgaagttgttcaacaagagagttaggtagtgccgcttgaaaaagtaatagtgcaaataagaaaaagaagcgaaacggcattcgtttaacaaaacgtcacatatttaggtatagtagattgcgttcacaaagaaatttaaatttaatttaccatttcgtcattgtatatgcggtaaacgtaaatttacacatatgacacgaactttgagttttattagcctgcctaattgttggtaacaatgtaatggaaattggcgatgactatgaaaaaaaaaaaaaaaaaaaaaaaaaaaaaa

SEQ ID NO: 64 - DNA, 561 bp, Artificial Sequence
  transcript variant
gaatattgtttcaatggtcgtggcgctggtcagactgctcgctaaagtcgtcgaagaaacagctagaccatctattctctgaacttcctaagtggtcgggttggtcgtggcgctcatagttagcccagaacgtccagtttatgtggtggtgatcttggttgccagactcagtatggtcaaaatagttgtgctcgccatttcaactagtgcagttgctaaagtgccaactaaggttcgtcttgaagcaatcggtagtatctgcagtcaagtcgtagtcgtaggtatggcacttgtcgtgcgtctaggacgcgttgaagctatcttattgcccgaaggagccgaaagtctgggacacgtcgtgggacgtatcgttaggactatgggactagtcgtcttcggtcttacaaattgagctacttatgaaacatgaatggtcggtcttgtggtcgcttttgtcgaaatcaccgaagtgcgtataattgatgaacgagtcgaagtcgaagttgttcaacaagagagttaggtagtgccaaaaaaaaaaaaaaaaaaaaaaaaaaaaaa

SEQ ID NO: 65 - DNA, 306 bp, Artificial Sequence
  transcript variant
gagatttctacgttgctgacaaagaggatgaccgtgacgcaaggtctttgagtgagacacatgaggctaacggcgtccactataccatgtggtgtggaagcgtctttgaccgtagcgtatagacgttttgcaatggcgtcttgttcattggggctggtttcgactgtcgctcagtctactctttcaacagtacttcgactaccttcttccatttgaccgactttagcgaaagccataccgatgaaggtagcgactttccgtcgttcccaaattagtaaaaaaaaaaaaaaaaaaaaaaaaaaaaaa

SEQ ID NO: 66 - DNA, 219 bp, Artificial Sequence
  transcript variant
gcagatactaccgattgcttcaagacgaaccttagttggcactttagcaactgcactagttgaaatggcgagcacaactattttgaccatactgagtctggcaaccaagatcaccaccacataaactggacgttctgggctaactatgagcgccacgaccaacccgaccacttaggaagttcagagaataaaaaaaaaaaaaaaaaaaaaaaaaaaaaa

SEQ ID NO: 67 - DNA, 2492 bp, Artificial Sequence
  transcript variant
gagacgatgaaacttgagaaatcgcactggcttacatatacacgataaaagactttaatacaatataagaagtcgttattgaagacggagatgtatgttaccgcccaattttagagatacaaaatgagactgacatagcggttaactatattagagcacgcctaagcattgaaggtttagtcatcttcattagagtatactgtattgacggctgaatgcaaataaattgagacaaaaccgatttcttgaattagcacgaagtaagtataaaactagtagagtgacaccaagtatatagggggtttatatcgcgtggaatcgaacaacatatctatttaattagtttaataacaaattaagtgacttatcgcggaagagagaacaatagattggattaaaaagttgtagtaaaccacaacgaagttaggtagctggtaaggttatagatgcgttctgtcgttgtagtcccaatgaacatagtatggtttcgcatagtaactgacctaaaagaccgccacatagtgaaaatacttaaaacgcaagtttcataggattaagtggtagaggctatagaaaatgatatcataactataacgaatataacagcaaattaaaatgcactggaagtggaaaatttcagcaagagagtcgaagtcgtcatagattagcatggataatggcaattatagttaaaatagtcgtaaattagattatggtgcaccggggtgtaagtttcgaactcggtgaggcaatagtagtatagactaacaacaaggtagacattgcaatgtattgcgagaagaacttcacgaagatatagatacagtacagaatttctaggattaagtacagcagacgtatttacacctgttataggatacttgttcacttaatccctgttatgacaaagtagtctcatagaatttttagaacgagaagatttgaatggacgtaaaggaagaaggtcaaaatggagaacttaaaaggggaaatctagaacattgaacccaacattatacaatgatataagaacgaaaagacgaagacaataaggtccatgggatttacccaaatgaggacctaaatcaccgggaagaagtaagtaaacataacgatatagttttagattatcgagaagtcgaagaagaccgggataggtaacagataatcgacgtttgggaagacggtaacgtaagaaactgaggaggttaaagaactaagaatcaacaacaagaaactattgtccctattctacttaggtatctgctagtatgcgatatggaagttaaagaggaaacagtagtatgcactgtttgagaaaattaggatttaagaggtggagaagtcgttagtttggaagcatagatagttcaaatatccacagaaggctattaaaagatagaagagagtcgagagatcgattttaaagtctgagtcgaaatagtttggtgcaagattatccattcaattcttatcgaaaacttacaaggtcaacaagtagagatagcaatataactaaaagctatctattgaacataaatgcgcgactacagcttgcgggttaacacggtcgtcttcattatacgtttaatcgacgccggcttattcatgcagatatttaactcaatcttcgataggatagaggacgtagtagacttggatgtctgtcatccagacatgagacatatacttatatggataatggtagtgcagcaaagtcgtataatttaaacggtatgggacgaagctaacaacatagaggtggacaacgtatagcaggtaattgttaaacttgttctggaaataaagaaagaaatcttttggactatgggcgtggcattagtatcaagagtagtcttggtttgtattatattggcagtgagcttattcgtaatagacgtaatctgtcgcacttacgtttagccaaattaggtccgtgaaacagacacaaacctatatttatgtggccacggacaaacgaaaactataagctacttcgcattctgaggtcttgttgggctaataatagactgcaatcacgttgctggggtggtatccttaactaacaatatggtaagtacggtgatagtgacattcaaaatagggtggtaacttagcatggtctacttggtggcagaagtggaagtggtagttatattcagctttatggttttacactgtatatttcacttggcggtcgccacaataaagatttagaatccactggcagaaagtcagcgcatttttatagcagacaacttgcaaagggagaggttcatgcaacgtgttatggtggatcaagttatcttagtaagacataaacttgtatagacaataacagtggcggaaattaaggttaagataattgtaactatagttccgggagagaactatttaattccgacaactgttatagccaaaatagatgaaatagagcgtataaaacctattcttccaagcgtaaaaaaaaaaaaaaaaaaaaaaaaaaaaaa

SEQ ID NO: 68 - DNA, 2277 bp, Artificial Sequence
  transcript variant
gattggattaaaaagttgtagtaaaccacaacgaagttaggtagctggtaaggttatagatgcgttctgtcgttgtagtcccaatgaacatagtatggtttcgcatagtaactgacctaaaagaccgccacatagtgaaaatacttaaaacgcaagtttcataggattaagtggtagaggctatagaaaatgatatcataactataacgaatataacagcaaattaaaatgcactggaagtggaaaatttcagcaagagagtcgaagtcgtcatagattagcatggacgaaagaaaagtcgcaaagatcggaaatcaagacgcaaaacaaaacggagaagttcaaatcgaactcgtagaacatatcgctggaacatattaaactcttggtatcgctcagttacaaaaggagacacgtagacacgaaagaaactggaacaacagacatatttgtggataatggcaattatagttaaaatagtcgtaaattagattatggtgcaccggggtgtaagtttcgaactcggtgaggcaatagtagtatagactaacaacaaggtagacattgcaatgtattgcgagaagaacttcacgaagatatagatacagtacagaatttctaggattaagtacagcagacgtatttacacctgttataggatacttgttcacttaatccctgttatgacaaagtagtctcatagaatttttagaacgagaagatttgaatggacgtaaaggaagaaggtcaaaatggagaacttaaaaggggaaatctagaacattgaacccaacattatacaatgatataagaacgaaaagacgaagacaataaggtccatgggatttacccaaatgaggacctaaatcaccgggaagaagtaagtaaacataacgatatagttttagattatcgagaagtcgaagaagaccgggataggtaacagataatcgacgtttgggaagacggtaacgtaagaaactgaggaggttaaagaactaagaatcaacaacaagaaactattgtccctattctacttaggtatctgctagtatgcgatatggaagttaaagaggaaacagtagtatgcactgtttgagaaaattaggatttaagaggtggagaagtcgttagtttggaagcatagatagttcaaatatccacagaaggctattaaaagatagaagagagtcgagagatcgattttaaagtctgagtcgaaatagtttggtgcaagattatccattcaattcttatcgaaaacttacaaggtcaacaagtagagatagcaatataactaaaagctatctattgaacataaatgcgcgactacagcttgcgggttaacacggtcgtcttcattatacgtttaatcgacgccggcttattcatgcagatatttaactcaatcttcgataggatagaggacgtagtagacttggatgtctgtcatccagacatgagacatatacttatatggataatggtagtgcagcaaagtcgtataatttaaacggtatgggacgaagctaacaacatagaggtggacaacgtatagcaggtaattgttaaacttgttctggaaataaagaaagaaatcttttggactatgggcgtggcattagtatcaagagtagtcttggtttgtattatattggcagtgagcttattcgtaatagacgtaatctgtcgcacttacgtttagccaaattaggtccgtgaaacagacacaaacctatatttatgtggccacggacaaacgaaaactataagctacttcgcattctgaggtcttgttgggctaataatagactgcaatcacgttgctggggtggtatccttaactaacaatatggtaagtacggtgatagtgacattcaaaatagggtggtaacttagcatggtctacttggtggcagaagtggaagtggtagttatattcagctttatggttttacactgtatatttcacttggcggtcgccacaataaagatttagaatccactggcagaaagtcagcgcatttttatagcagacaacttgcaaagggagaggttcatgcaacgtgttatggtggatcaagttatcttagtaagacataaacttgtatagacaataacagtggcggaaattaaggttaagataattgtaactatagttccgggagagaactatttaattccgacaactgttatagccaaaatagatgaaatagagcgtataaaacctattcttccaagcgtaataaaaaaaaaaaaaaaaaaaaaaaaaaaaaa

SEQ ID NO: 69 - DNA, 2528 bp, Artificial Sequence
  transcript variant
gatgaaacttgagaaatcgcactggcttacatatacacgataaaagactttaatacaatataagaagtcgttattgaagacggagatgtatgttaccgcccaattttagagatacaaaatgagactgacatagcggttaactatattagagcacgcctaagcattgaaggtttagtcatcttcattagagtatactgtattgacggctgaatgcaaataaattgagacaaaaccgatttcttgaattagcacgaagtaagtataaaactagtagagtgacaccaagtatatagggggtttatatcgcgtggaatcgaacaacatatctatttaattagtttaataacaaattaagtgacttatcgcggaagagagaacaatagattggattaaaaagttgtagtaaaccacaacgaagttaggtagctggtaaggttatagatgcgttctgtcgttgtagtcccaatgaacatagtatggtttcgcatagtaactgacctaaaagaccgccacatagtgaaaatacttaaaacgcaagtttcataggattaagtggtagaggctatagaaaatgatatcataactataacgaatataacagcaaattaaaatgcactggatgttagagcaaattatataaactttcacatgctaaccaacgtaatttgagaagaaatcatcaagaattaaactaaaggaatggtggataatggcaattatagttaaaatagtcgtaaattagattatggtgcaccggggtgtaagtttcgaactcggtgaggcaatagtagtatagactaacaacaaggtagacattgcaatgtattgcgagaagaacttcacgaagatatagatacagtacagaatttctaggattaagtacagcagacgtatttacacctgttataggatacttgttcacttaatccctgttatgacaaagtagtctcatagaatttttagaacgagaagatttgaatggacgtaaaggaagaaggtcaaaatggagaacttaaaaggggaaatctagaacattgaacccaacattatacaatgatataagaacgaaaagacgaagacaataaggtccatgggatttacccaaatgaggacctaaatcaccgggaagaagtaagtaaacataacgatatagttttagattatcgagaagtcgaagaagaccgggataggtaacagataatcgacgtttgggaagacggtaacgtaagaaactgaggaggttaaagaactaagaatcaacaacaagaaactattgtccctattctacttaggtatctgctagtatgcgatatggaagttaaagaggaaacagtagtatgcactgtttgagaaaattaggatttaagaggtggagaagtcgttagtttggaagcatagatagttcaaatatccacagaaggctattaaaagatagaagagagtcgagagatcgattttaaagtctgagtcgaaatagtttggtgcaagattatccattcaattcttatcgaaaacttacaaggtcaacaagtagagatagcaatataactaaaagctatctattgaacataaatgcgcgactacagcttgcgggttaacacggtcgtcttcattatacgtttaatcgacgccggcttattcatgcagatatttaactcaatcttcgataggatagaggacgtagtagacttggatgtctgtcatccagacatgagacatatacttatatggataatggtagtgcagcaaagtcgtataatttaaacggtatgggacgaagctaacaacatagaggtggacaacgtatagcaggtaattgttaaacttgttctggaaataaagaaagaaatcttttggactatgggcgtggcattagtatcaagagtagtcttggtttgtattatattggcagtgagcttattcgtaatagacgtaatctgtcgcacttacgtttagccaaattaggtccgtgaaacagacacaaacctatatttatgtggccacggacaaacgaaaactataagctacttcgcattctgaggtcttgttgggctaataatagactgcaatcacgttgctggggtggtatccttaactaacaatatggtaagtacggtgatagtgacattcaaaatagggtggtaacttagcatggtctacttggtggcagaagtggaagtggtagttatattcagctttatggttttacactgtatatttcacttggcggtcgccacaataaagatttagaatccactggcagaaagtcagcgcatttttatagcagacaacttgcaaagggagaggttcatgcaacgtgttatggtggatcaagttatcttagtaagacataaacttgtatagacaataacagtggcggaaattaaggttaagataattgtaactatagttccgggagagaactatttaattccgacaactgttatagccaaaatagatgaaatagagcgtataaaacctattcttccaagcgtaataaaaaaaaaaaaaaaaaaaaaaaaaaaaaa

SEQ ID NO: 70 - DNA, 458 bp, Artificial Sequence
  transcript variant
ggctatagaaaatgatatcataactataacgaatataacagcaaattaaaatgcactggataataaaaattaaactaatatttgtagttagtggtgcagatttgaacgaacagtcaggcgaaatggaagtaatagatgattcatggacgataagtcattaagacatcgaagactgttttgttgttatggcagaaacagacaaaatatcaggctacaaaaatgtatcagagcattaacatgaaaaatcctaagagatcgacgaagttatcgactaaattgttgtaatccaagaggctgattgacgtttagaagtaagtggcaatttggtttaaaacaacgataataaaggttgcgaagaaatataaaaagtagtcacataacactgacattattaaatttagatagactttaccgctaaaactgtagttaaaaaaaaaaaaaaaaaaaaaaaaaaaaaa

SEQ ID NO: 71 - DNA, 2492 bp, Artificial Sequence
  transcript variant
gtgagacgatgaaacttgagaaatcgcactggcttacatatacacgataaaagactttaatacaatataagaagtcgttattgaagacggagatgtatgttaccgcccaattttagagatacaaaatgagactgacatagcggttaactatattagagcacgcctaagcattgaaggtttagtcatcttcattagagtatactgtattgacggctgaatgcaaataaattgagacaaaaccgatttcttgaattagcacgaagtaagtataaaactagtagagtgacaccaagtatatagggggtttatatcgcgtggaatcgaacaacatatctatttaattagtttaataacaaattaagtgacttatcgcggaagagagaacaatagattggattaaaaagttgtagtaaaccacaacgaagttaggtagctggtaaggttatagatgcgttctgtcgttgtagtcccaatgaacatagtatggtttcgcatagtaactgacctaaaagaccgccacatagtgaaaatacttaaaacgcaagtttcataggattaagtggtagaggctatagaaaatgatatcataactataacgaatataacagcaaattaaaatgcactggaagtggaaaatttcagcaagagagtcgaagtcgtcatagattagcatggataatggcaattatagttaaaatagtcgtaaattagattatggtgcaccggggtgtaagtttcgaactcggtgaggcaatagtagtatagactaacaacaaggtagacattgcaatgtattgcgagaagaacttcacgaagatatagatacagtacagaatttctaggattaagtacagcagacgtatttacacctgttataggatacttgttcacttaatccctgttatgacaaagtagtctcatagaatttttagaacgagaagatttgaatggacgtaaaggaagaaggtcaaaatggagaacttaaaaggggaaatctagaacattgaacccaacattatacaatgatataagaacgaaaagacgaagacaataaggtccatgggatttacccaaatgaggacctaaatcaccgggaagaagtaagtaaacataacgatatagttttagattatcgagaagtcgaagaagaccgggataggtaacagataatcgacgtttgggaagacggtaacgtaagaaactgaggaggttaaagaactaagaatcaacaacaagaaactattgtccctattctacttaggtatctgctagtatgcgatatggaagttaaagaggaaacagtagtatgcactgtttgagaaaattaggatttaagaggtggagaagtcgttagtttggaagcatagatagttcaaatatccacagaaggctattaaaagatagaagagagtcgagagatcgattttaaagtctgagtcgaaatagtttggtgcaagattatccattcaattcttatcgaaaacttacaaggtcaacaagtagagatagcaatataactaaaagctatctattgaacataaatgcgcgactacagcttgcgggttaacacggtcgtcttcattatacgtttaatcgacgccggcttattcatgcagatatttaactcaatcttcgataggatagaggacgtagtagacttggatgtctgtcatccagacatgagacatatacttatatggataatggtagtgcagcaaagtcgtataatttaaacggtatgggacgaagctaacaacatagaggtggacaacgtatagcaggtaattgttaaacttgttctggaaataaagaaagaaatcttttggactatgggcgtggcattagtatcaagagtagtcttggtttgtattatattggcagtgagcttattcgtaatagacgtaatctgtcgcacttacgtttagccaaattaggtccgtgaaacagacacaaacctatatttatgtggccacggacaaacgaaaactataagctacttcgcattctgaggtcttgttgggctaataatagactgcaatcacgttgctggggtggtatccttaactaacaatatggtaagtacggtgatagtgacattcaaaatagggtggtaacttagcatggtctacttggtggcagaagtggaagtggtagttatattcagctttatggttttacactgtatatttcacttggcggtcgccacaataaagatttagaatccactggcagaaagtcagcgcatttttatagcagacaacttgcaaagggagaggttcatgcaacgtgttatggtggatcaagttatcttagtaagacataaacttgtatagacaataacagtggcggaaattaaggttaagataattgtaactatagttccgggagagaactatttaattccgacaactgttatagccaaaatagatgaaatagagcgtataaaacctattcttccaagcaaaaaaaaaaaaaaaaaaaaaaaaaaaaaa

SEQ ID NO: 72 - DNA, 979 bp, Artificial Sequence
  transcript variant
gtgccaaattagcgaacaatttgagaagagcagtgagacgatgaaacttgagaaatcgcactggcttacatatacacgataaaagactttaatacaatataagaagtcgttattgaagacggagatgtatgttaccgcccaattttagagatacaaaatgagactgacatagcggttaactatattagagcacgcctaagcattgaaggtttagtcatcttcattagagtatactgtattgacggctgaatgcaaataaattgagacaaaaccgatttcttgaattagcacgaagtaagtataaaactagtagagtgacaccaagtatatagggggtttatatcgcgtggaatcgaacaacatatctatttaattagtttaataacaaattaagtgacttatcgcggaagagagaacaatagattggattaaaaagttgtagtaaaccacaacgaagttaggtagctggtaaggttatagatgcgttctgtcgttgtagtcccaatgaacatagtatggtttcgcatagtaactgacctaaaagaccgccacatagtgaaaatacttaaaacgcaagtttcataggattaagtggtagaggctatagaaaatgatatcataactataacgaatataacagcaaattaaaatgcactggataataaaaattaaactaatatttgtagttagtggtgcagatttgaacgaacagtcaggcgaaatggaagtaatagatgattcatggacgataagtcattaagacatcgaagactgttttggatgtagacatatttgtagaacattaaagaaagatatgagttctttatttcaaaaacatagatggttggctggttagcaacgtcaaagcccacagtatctaatgttgttatggcagaaacagacaaaatatcaggctacaaaaatgtatcagagcattaacatgaaaaataaaaaaaaaaaaaaaaaaaaaaaaaaaaaa

SEQ ID NO: 73 - DNA, 2356 bp, Artificial Sequence
  transcript variant
gcactggcttacatatacacgataaaagactttaatacaatataagaagtcgttattgaagacggagatgtatgttaccgcccaattttagagatacaaaatgagactgacatagcggttaactatattagagcacgcctaagcattgaaggtttagtcatcttcattagagtatactgtattgacggctgaatgcaaataaattgagacaaaaccgatttcttgaattagcacgaagtaagtataaaactagtagagtgacaccaagtatatagggggtttatatcgcgtggataataaaaattaaactaatatttgtagttagtggtgcagatttgaacgaacagtcaggcgaaatggaagtaatagatgattcatggacgataagtcattaagacatcgaagactgttttggaagtggaaaatttcagcaagagagtcgaagtcgtcatagattagcatggatttcgaagaacgcgaagaactaaacgaacaagttatgaacgaaattagagtcctaataacctgtttagtgaattgaccagtagtcatataacaaaaacaagaaggttaggcaaagctataagcaaatagcattgaaatagaaatggacgagaagaaggctttaaaatggtagtcgtatgcgaacgctaaggaagagaaattctagtagaactcgtagttacatacttggacgaaagaaaagtcgcaaagatcggaaatcaagacgcaaaacaaaacggagaagttcaaatcgaactcgtagaacatatcgctggaacatattaaactcttggtatcgctcagttacaaaaggagacacgtagacacgaaagaaactggaacaacagacatatttgtggatgttagagcaaattatataaactttcacatgctaaccaacgtaatttgagaagaaatcatcaagaattaaactaaaggaatggtggataatggcaattatagttaaaatagtcgtaaattagattatggtgcaccggggtgtaagtttcgaactcggtgaggcaatagtagtatagactaacaacaaggtagacattgcaatgtattgcgagaagaacttcacgaagatatagatacagtacagaatttctaggattaagtacagcagacgtatttacacctgttataggatacttgttcacttaatccctgttatgacaaagtagtctcatagaatttttagaacgagaagatttgaatggacgtaaaggaagaaggtcaaaatggagaacttaaaaggggaaatctagaacattgaacccaacattatacaatgatataagaacgaaaagacgaagacaataaggtccatgggatttacccaaatgaggacctaaatcaccgggaagaagtaagtaaacataacgatatagttttagattatcgagaagtcgaagaagaccgggataggtaacagataatcgacgtttgggaagacggtaacgtaagaaactgaggaggttaaagaactaagaatcaacaacaagaaactattgtccctattctacttaggtatctgctagtatgcgatatggaagttaaagaggaaacagtagtatgcactgtttgagaaaattaggatttaagaggtggagaagtcgttagtttggaagcatagatagttcaaatatccacagaaggctattaaaagatagaagagagtcgagagatcgattttaaagtctgagtcgaaatagtttggtgcaagattatccattcaattcttatcgaaaacttacaaggtcaacaagtagagatagcaatataactaaaagctatctattgaacataaatgcgcgactacagcttgcgggttaacacggtcgtcttcattatacgtttaatcgacgccggcttattcatgcagatatttaactcaatcttcgataggatagaggacgtagtagacttggatgtctgtcatccagacatgagacatatacttatatggataatggtagtgcagcaaagtcgtataatttaaacggtatgggacgaagctaacaacatagaggtggacaacgtatagcaggtaattgttaaacttgttctggaaataaagaaagaaatcttttggactatgggcgtggcattagtatcaagagtagtcttggtttgtattatattggcagtgagcttattcgtaatagacgtaatctgtcgcacttacgtttagccaaattaggtccgtgaaacagacacaaacctatatttatgtggccacggacaaacgaaaactataagctacttcgcattctgaggtcttgttgggctaataatagactgcaatcacgttgctgggaaaaaaaaaaaaaaaaaaaaaaaaaaaaaa

SEQ ID NO: 74 - DNA, 919 bp, Artificial Sequence
  transcript variant
gtgccaaattagcgaacaatttgagaagagcagtgagacgatgaaacttgagaaatcgcactggcttacatatacacgataaaagactttaatacaatataagaagtcgttattgaagacggagatgtatgttaccgcccaattttagagatacaaaatgagactgacatagcggttaactatattagagcacgcctaagcattgaaggtttagtcatcttcattagagtatactgtattgacggctgaatgcaaataaattgagacaaaaccgatttcttgaattagcacgaagtaagtataaaactagtagagtgacaccaagtatatagggggtttatatcgcgtgtttaataacaaattaagtgacttatcgcggaagagagaacaatagattggattaaaaagttgtagtaaaccacaacgaagttaggtagctggtaaggttatagatgcgttctgtcgttgtagtcccaatgaacatagtatggtttcgcatagtaactgacctaaaagaccgccacatagtgaaaatacttaaaacgcaagtttcataggattaagtggtagaggctatagaaaatgatatcataactataacgaatataacagcaaattaaaatgataataaaaattaaactaatatttgtagttagtgtcaggcgaaatggaagtaatagatgattcatggacgataagtcattaagacatcgaagactgttttggatgtagacatatttgtagaacattaaagaaagatatgagttctttatttcaaaaacatagatggttggctggttagcaacgtcaaagcccacagtatctaatgttgttatggcagaaacagacaaaatatcaggctacaaaaatgtatcagagcattaacatgaaaaaaaaaaaaaaaaaaaaaaaaaaaaaa

SEQ ID NO: 75 - DNA, 1561 bp, Artificial Sequence
  transcript variant
gcttgtccgcgagtgtcaaccgggttttacaaaggagaacttccaacatcagtgtatgggatgtttcaaacacccccagagacggagacaatagtgtggtcacgtacatttaggaagataaaaataacaacaacagaaggtgtgaggcgcaaggtacatgctcttaccccactctcagcacgtagggagcggagtgtggaagaccaacaagcccgtcgcctctaccaaatacagctatcctgaggtgccaggttagaataggccctaccacatctaagccttgaaacggtctgttcctcgtgtcaagttctttgtccgcttataccgccatctctcgttgtggtacaagagttggttactctcagtcccattcccaacacatcactgagaagtatagagcctagtggtcattagaaggtcaacatggagtaggtgtttaggtgtgtcggagggcagaaaccaacgaaagaaaggaaacgatcaacacttatatagtgtcctgtcgggcccaaatcctaagagaccttaggtttaccacattagtactaaacagcctgttgtataccgtgagcccccacttcgatctgtaaatggtaatcccttgtaaaacctcatctccaaaaacagtatacgcaggtacagctgatgtgatcctctctactagtcttctctgaggaaccatgagatggatagtgggggacctgagtcatactagggtaacttcttatatggtgacatcactcctaccgtagaggggggacggtagtctgtgggaaatctaccctagtgaagaaaggtaagagaatgtctgaacattacctgtagacgaaggtactctcagaacaactactctcacatacggaaaggtttgggtccttggtcaaaggactttactgactctgcagacgatgaatatctgaaccaacactactatcaaagatgttcgactagacctctcgtggtagggcctggaagtcaaaagacttctctatgggtactaggtaggtagttagagtacggtccctggggtgtctcagagtcgaacgttcgggggaagttcctaaacatgttaggatgttatgataacaagtccaaacgtggacgtcgtcgctgtcacctctcggaacactagctgaggtggcttaaaaacattccgtaactgagtggtcaccgggggtgaaacatgctgagggttctaccttaacgggaaggtgaaactctccaatgtctttgaaaggactagttgagataacccaaaccgaatccggaggaagaggagaacttggaaaacgttgtacgacgtcattaataacgattccgttcttcccgttcgtgtctataaggatattctttcattgcgaaggtaagcccttttgggtctagatacggactatactcaaaaacccacagaccttccacttggagttgttttaggagacggagtagtagagaaaacttgtggcaccttcccagtcggttccctacagactctccttagtagctcctaagatcgtcgagttacacgacgacattgttccgactgacgtagaggcattacttt

SEQ ID NO: 76 - DNA, 1300 bp, Artificial Sequence
  transcript variant
gtacaagagttggttactctcagtcccattcccaacacatcactgagaagtatagagcctagtggtcattagaaggtcaacatggagtaggtgtttaggtgtgtcggagggcagaaaccaacgaaagaaaggaaacgatcaacacttatatagtgtcctgtcgggcccaaatcctaagagaccttaggtttaccacattagtactaaacagcctgttgtataccgtgagcccccacttcgatctgtaaatggtaatcccttgtaaaacctcatctccaaaaacagtatacgcaggtacagctgatgtgatcctctctactagtcttctctgaggaaccatgagatggatagtgggggacctgagtcatactagggtaacttcttatatggtgacatcactcctaccgtagaggggggacggtagtctgtgggaaatctaccctagtgaagaaaggtaagagaatgtctgaacattacctgtagacgaaggtactctcagaacaactactctcacatacggaaaggtttgggtccttggtcaaaggactttactgactctgcagacgatgaatatctgaaccaacactactatcaaagatgtcgtaggtttgtgagaagggagaagaagtggttgagaagttggtgttccacaagttaaagtagacatacctttagtacctgtaaaggttcgactagacctctcgtggtagggcctggaagtcaaaagacttctctatgggtactaggtaggtagttagagtacggtccctggggtgtctcagagtcgaacgttcgggggaagttcctaaacatgttaggatgttatgataacaagtccaaacgtggacgtcgtcgctgtcacctctcggaacactagctgaggtggcttaaaaacattccgtaactgagtggtcaccgggggtgaaacatgctgagggttctaccttaacgggaaggtgaaactctccaatgtctttgaaaggactagttgagataacccaaaccgaatccggaggaagaggagaacttggaaaacgttgtacgacgtcattaataacgattccgttcttcccgttcgtgtctataaggatattctttcattgcgaaggtaagcccttttgggtctagatacggactatactcaaaaacccacagaccttccacttggagttgttttaggagacggagtagtagagaaaacttgtggcaccttcccagtcggttccctacagactctccttagtagctcctaagatcgtcgagttacacgacgacattgttccgactgacgtagaggcat

SEQ ID NO: 77 - DNA, 1363 bp, Artificial Sequence
  transcript variant
gtgaggcttgtccgcgagtgtcaaccgggttttacaaaggagaacttccaacatcagtgtatgggatgtttcaaacacccccagagacggagacaatagtgtggtcacgtacatttaggaagataaaaataacaacaacagaaggtacaagagttggttactctcagtcccattcccaacacatcactgagaagtatagagcctagtggtcattagaaggtcaacatggagtaggtgtttaggtgtgtcggagggcagaaaccaacgaaagaaaggaaacgatcaacacttatatagtgtcctgtcgggcccaaatcctaagagaccttaggtttaccacattagtactaaacagcctgttgtataccgtgagcccccacttcgatctgtaaatggtaatcccttgtaaaacctcatctccaaaaacagtatacgcaggtacagctgatgtgatcctctctactagtcttctctgaggaaccatgagatggatagtgggggacctgagtcatactagggtaacttcttatatggtgacatcactcctaccgtagaggggggacggtagtctgtgggaaatctaccctagtgaagaaaggtaagagaatgtctgaacattacctgtagacgaaggtactctcagaacaactactctcacatacggaaaggtttgggtccttggtcaaaggactttactgactctgcagacgatgaatatctgaaccaacactactatcaaagatgttcgactagacctctcgtggtagggcctggaagtcaaaagacttctctatgggtactaggtaggtagttagagtacggtccctggggtgtctcagagtcgaacgttcgggggaagttcctaaacatgttaggatgttatgataacaagtccaaacgtggacgtcgtcgctgtcacctctcggaacactagctgaggtggcttaaaaacattccgtaactgagtggtcaccgggggtgaaacatgctgagggttctaccttaacgggaaggtgaaactctccaatgtctttgaaaggactagttgagataacccaaaccgaatccggaggaagaggagaacttggaaaacgttgtacgacgtcattaataacgattccgttcttcccgttcgtgtctataaggatattctttcattgcgaaggtaagcccttttgggtctagatacggactatactcaaaaacccacagaccttccacttggagttgttttaggagacggagtagtagagaaaacttgtggcaccttcccagtcggttccctacagactctccttagtagctcctaagatcgtcgagttacacgacgacattgttccgactgacgtagaggcattacttt

SEQ ID NO: 78 - DNA, 1399 bp, Artificial Sequence
  transcript variant
gttttacaaaggagaacttccaacatcagtgtatgggatgtttcaaacacccccagagacggagacaatagtgtggtcacgtacatttaggaagataaaaataacaacaacagaagccttgaaacggtctgttcctcgtgtcaagttctttgtccgcttataccgccatctctcgttgtggtacaagagttggttactctcagtcccattcccaacacatcactgagaagtatagagcctagtggtcattagaaggtcaacatggagtaggtgtttaggtgtgtcggagggcagaaaccaacgaaagaaaggaaacgatcaacacttatatagtgtcctgtcgggcccaaatcctaagagaccttaggtttaccacattagtactaaacagcctgttgtataccgtgagcccccacttcgatctgtaaatggtaatcccttgtaaaacctcatctccaaaaacagtatacgcaggtacagctgatgtgatcctctctactagtcttctctgaggaaccatgagatggatagtgggggacctgagtcatactagggtaacttcttatatggtgacatcactcctaccgtagaggggggacggtagtctgtgggaaatctaccctagtgaagaaaggtaagagaatgtctgaacattacctgtagacgaaggtactctcagaacaactactctcacatacggaaaggtttgggtccttggtcaaaggactttactgactctgcagacgatgaatatctgaaccaacactactatcaaagatgttcgactagacctctcgtggtagggcctggaagtcaaaagacttctctatgggtactaggtaggtagttagagtacggtccctggggtgtctcagagtcgaacgttcgggggaagttcctaaacatgttaggatgttatgataacaagtccaaacgtggacgtcgtcgctgtcacctctcggaacactagctgaggtggcttaaaaacattccgtaactgagtggtcaccgggggtgaaacatgctgagggttctaccttaacgggaaggtgaaactctccaatgtctttgaaaggactagttgagataacccaaaccgaatccggaggaagaggagaacttggaaaacgttgtacgacgtcattaataacgattccgttcttcccgttcgtgtctataaggatattctttcattgcgaaggtaagcccttttgggtctagatacggactatactcaaaaacccacagaccttccacttggagttgttttaggagacggagtagtagagaaaacttgtggcaccttcccagtcggttccctacagactctccttagtagctcctaagatcgtcgagttacacgacgacattgttccgactgacgtagaggcattacttt

SEQ ID NO: 79 - DNA, 670 bp, Artificial Sequence
  transcript variant
gcgcaaggtacatgctcttaccccactctcagcacgtagggagcggagtacaagagttggttactctcagtcccattcccaacacatcactgagaagtatagagcctagtggtcattagaaggtcaacatggagtaggtgtttaggtgtgtcggagggcagaaaccaacgaaagaaaggaaacgatcaacacttatatagtgtcctgtcgggcccaaatcctaagagaccttaggtttaccacattagtactaaacagcctgttgtataccgtgagcccccacttcgatctgtaaatggtaatcccttgtaaaacctcatctccaaaaacagtatacgcaggtacagctgatgtgatcctctctactagtcttctctgaggaaccatgagatggatagtgggggacctgagtcatactagggtaacttcttatatggtgacatcactcctaccgtagaggggggacggtagtctgtgggaaatctaccctagtgaagaaaggtaagagaatgtctgaacattacctgtagacgaaggtactctcagaacaactactctcacatacggaaaggtttgggtccttggtcaaaggactttactgactctgcagacgatgaatatctgaaccaacactactatcaaagatgttcgactagacctctcgtggtag

SEQ ID NO: 80 - DNA, 973 bp, Artificial Sequence
  transcript variant
gcttgtccgcgagtgtcaaccgggttttacaaaggagaacttccaacatcagtgtatgggatgtttcaaacacccccagagacggagacaatagtgtggtcacgtacatttaggaagataaaaataacaacaacagaaggtgtgaggcgcaaggtacatgctcttaccccactctcagcacgtagggagcggagtgtggaagaccaacaagcccgtcgcctctaccaaatacagtgtttaggtgtgtcggagggcagaaaccaacgaaagaaaggaaacgatcaacacttatatagtgtcctgtcgggcccaaatcctaagagaccttaggtttaccacattagtactaaacagcctgttgtataccgtgagcccccacttcgatctgtaaatggtaatcccttgtaaaacctcatctccaaaaacagtatacgcaggtacagctgatgtgatcctctctactagtcttctctgaggaaccatgagatgttatgataacaagtccaaacgtggacgtcgtcgctgtcacctctcggaacactagctgaggtggcttaaaaacattccgtaactgagtggtcaccgggggtgaaacatgctgagggttctaccttaacgggaaggtgaaactctccaatgtctttgaaaggactagttgagataacccaaaccgaatccggaggaagaggagaacttggaaaacgttgtacgacgtcattaataacgattccgttcttcccgttcgtgtctataaggatattctttcattgcgaaggtaagcccttttgggtctagatacggactatactcaaaaacccacagaccttccacttggagttgttttaggagacggagtagtagagaaaacttgtggcaccttcccagtcggttccctacagactctccttagtagctcctaagatcgtcgagttacacgacgacattgttccgactgacgtagaggcattacttt

SEQ ID NO: 81 - DNA, 744 bp, Artificial Sequence
  transcript variant
gtgaggcatctataccgccacgccctatgtctttctcacgtataggtgtgctctcagctgccgttccggcgctgcttcacccctttccgcttatcgcggatggtaaagtcaaagtttactcagcggtcgctgttgacctcaggttctctatcaaaaatttgctggctaaaacggtcggagcttctgctccactctttccagcaatccttctgccagtcgccttcaaacttgcaatctgtggattcgtcgaacgtccgggtagtatagttatctgcatcgtggtcaccagtatcacagactacaaaatctcaatcctccattcccccgtcaggtctatctaaaattcaatcgctgtgtttgcggggtaaataataggacaagtccgtataatctacccaatcgcattcattccagtcagagggtaccaccgaatttcatcaacaacattaataattccataggaactacattcttaaatccttggaactccaaactcctaccttatcacggttctatccgtcgtcttagggtcggtctcctcgtagcatggcctcgttctcctcgccgtaattgcggtcgaaagtacttcagttatttatggtgaggcttgtccgcgagtgtcaaccgggttttacaaaggagaacttccaacatcagtgtatgggatgtttcaaacacccccagagacggagacaatagtgtggtcacgtacatttaggaagataaaaataacaacaacagaag

SEQ ID NO: 82 - DNA, 702 bp, Artificial Sequence
  transcript variant
gtcttccacactccgctccctacgtgctgagagtggggtaagagcatgtaccttgcgcctcacaccttctgttgttgttatttttatcttcctaaatgtacgtgaccacactattgtctccgtctctgggggtgtttgaaacatcccatacactgatgttggaagttctcctttgtaaaacccggttgacactcgcggacaagcctcactactttcgaccgcaattacggcgaggagaacgaggccatgctacgaggagaccgaccctaagacgacggatagaaccgtgataaggtaggagtttggagttccaaggatttaagaatgtagttcctatggaattattaatgttgttgatgaaattcggtggtaccctctgactggaatgaatgcgattgggtagattatacggacttgtcctattatttaccccgcaaacacagcgattgaattttagatagacctgacgggggaatggaggattgagattttgtagtctcacagattgcaagtttgaaggcgactggcagaaggattgctggaaagagtggagcagaagctccgaccgttttagccagcaaatttttgatagagaacctgaggtcaacagcgaccgctgagtaaactttgactttaccatccgcgataagcggaaaggggtgaagcagcgccggaacggcagctgagagcacacctatacgt

SEQ ID NO: 83 - DNA, 464 bp, Artificial Sequence
  transcript variant
gggtgtttgaaacatcccatacactgatgttggaagttctcctttgtaaaacccggttgacactcgcggacaagcctcaccataaataactgaagtactttcgaccgcaattacggcgaggagaacgaggccatgctacgaggagaccgaccctaagacgacggatagaaccgtgataaggtaggagtttggagttccaaggatttaagaatgtagttcctatggaattattaatgttgttgatgaaattcggtgaaggattgctggaaagagtggagcagaagctccgaccgttttagccagcaaatttttgatagagaacctgaggtcaacagcgaccgctgagtaaactttgactttaccatccgcgataagcggaaaggggtgaagcagcgccggaacggcagctgagagcacacctatacgtgagaaagacatagggcgtggcggtatagatgcctcac

SEQ ID NO: 84 - DNA, 2051 bp, Artificial Sequence
  transcript variant
gtgtatttatccgctacgtggtggatgaacatggatgcgaacgacatttcgaaatatacgcaatgatatccaaccctaccgaaacagcaataattgtagaaggtagcatatcatgccgagagtttactacgttgtagcgagtttagttgaaatagtttgtgatgtgtaaactaaaacataccaaatggtaaaacttgtcacccccatttacattgcgacagacacagttatggagtggatggaagtgtgttcgactgtcaagacccttctataatagtcgaaccagtacggtaagtgggcaacatgcccatataagtcgaagcatttcaaatggttcatccagtagacgacgatgtcctagacagtcatgtctcttccccatttgaagtcatgtagtggttgtctactttttcattgaagacgtccacctcaacgctatgaacgttagttgagacaatgttaaagcaaacgacaacgtcattgtgatctacatacacagtggatggttagcgtaaacatggtggaacgtactttgactgcgctgcaagaaatggttgggtcgatcgtaatgctagtcgttacatcggaacaagccaaaacaaatcattcgctggatttagacctactgcacgacgacgtcgacacaagacattcttgaaaggaattcaatgcagaaactcctatgcacgtcgaactagtctcttgctcagcgctagtccatgaaaatgtcctagctttgaacgtttatcaaatgcaagttgtgggagttagtcatgtgagagttgtgcaagaaagtgttaacgttctagccgtgctcagtaacaattaccattcggcggtaacaaacgtaagttgtcactgcactcatgagcatgaagttagaccagtagttgggtcagaaattagacgtggtttagtctggttaccgtggaaagaatagctgaactcaaagaagccgacaaagataaacaaagaagaaacggttaatacgattgaggagaaatattcaatccaacggcaactattaacgtttcaactagaatctacgtttcatacgcggattccacatccgttcttgcaattaaagaaacgatgtagaaaacgctttggttggcgacaacttgggcggcaaaataattatggtaggtaattgaagtagcgttaaaacgcaaaaagaaggaagcacggatcactgcaaaaaggactactcaataatggtttctaaagtcattatgctggtgctccctatggcggtggtcagtactgtaactaaagatggattacggcacttgtagagcacgtatcagacccagctttgaaagaaggctgagttcggttcgggtttcacgtaggcctagaacgaggtatagaagtggttaacaaagatttggttaccatgtaagaagcggtagacgccatggcctagtaggaagaatgcttgttcacggagccgacgaagttagacgagtggcagaagaaagagcattatcttggtactcggactgaatgcgtactacggtcgtccaagttgcaagaggtattagagtcattcgaatagctgtgggagtggtatttatagcataataagtgtaaaaaacattcccaacagcatatgtgtagccaagaagcgttgtgctcgcgactaaaagtcaggtagcagcaggcattaacccagtgatagaacatcaaagtcaaataagtatggtttagcattactgcgtatcttgcgattgcgtgctggtggtcaacagtgcaaacctagtggcttcgcactcaaatgtagacaagcattaaccaactacttctaacgtatgttcaggaagaatggctattctcgtcaggtgaatgcgtaatcgaatgagtagtatggtcgaacgtcccgctatagtctgacacgattcaggcaaagttggagtgcaaagccatgatttggtcgatgcggcaaatgttgcttaggactattctatggtcttgcgtaattgtgaagatttgccagttatctaaggagacgtggtgattcgctctatagctgtatctaatctgccagattg

SEQ ID NO: 85 - DNA, 1971 bp, Artificial Sequence
  transcript variant
gttggtgtatttatccgctacgtggtggatgaacatggatgcgaacgacatttcgaaatatacgcaatgatatccaaccctaccgaaacagcaataattgtagaaggtagcatatcatgccgagagtttactacgttgtagcgagtttagttgaaatagtttgtgatgtgtaaactaaaacataccaaatggtaaaacttgtcacccccatttacattgcgacagacacagttatggagtggatggaagtgtgttcgactgtcaagacccttctataatagtcgaaccagtacggtaagtgggcaacatgcccatataagtcgaagcatttcaaatggttcatccagtagacgacgatgtcctagacagtcatgtctcttccccatttgaagtcatgtagtggttgtctactttttcattgaagacgtccacctcaacgctatgaacgttagttgagacaatgttaaagcaaacgacaacgtcattgtgatctacatacacagtggatggttagcgtaaacatggtggaacgtactttgactgcgctgcaagaaatggttgggtcgatcgtaatgctagtcgttacatcggaacaagccaaaacaaatcattcgctggatttagacctactgcacgacgacgtcgacacaagacattcttgaaagcgctagtccatgaaaatgtcctagctttgaacgtttatcaaatgcaagttgtgggagttagtcatgtgagagttgtgcaagaaagtgttaacgttctagccgtgctcagtaacaattaccattcggcggtaacaaacgtaagttgtcactgcactcatgagcatgaagttagaccagtagttgggtcagaaattagacgtggtttagtctggttaccgtggaaagaatagctgaactcaaagaagccgacaaagataaacaaagaagaaacggttaatacgattgaggagaaatattcaatccaacggcaactattaacgtttcaactagaatctacgtttcatacgcggattccacatccgttcttgcaattaaagaaacgatgtagaaaacgctttggttggcgacaacttgggcggcaaaataattatggtaggtaattgaagtagcgttaaaacgcaaaaagaaggaagcacggatcactgcaaaaaggactactcaataatggtttctaaagtcattatgctggtgctccctatggcggtggtcagtactgtaactaaagatggattacggcacttgtagagcacgtatcagacccagctttgaaagaaggctgagttcggttcgggtttcacgtaggcctagaacgaggtatagaagtggttaacaaagatttggttaccatgtaagaagcggtagacgccatggcctagtaggaagaatgcttgttcacggagccgacgaagttagacgagtggcagaagaaagagcattatcttggtactcggactgaatgcgtactacggtcgtccaagttgcaagaggtattagagtcattcgaatagctgtgggagtggtatttatagcataataagtgtaaaaaacattcccaacagcatatgtgtagccaagaagcgttgtgctcgcgactaaaagtcaggtagcagcaggcattaacccagtgatagaacatcaaagtcaaataagtatggtttagcattactgcgtatcttgcgattgcgtgctggtggtcaacagtgcaaacctagtggcttcgcactcaaatgtagacaagcattaaccaactacttctaacgtatgttcaggaagaatggctattctcgtcaggtgaatgcgtaatcgaatgagtagtatggtcgaacgtcccgctatagtctgacacgattcaggcaaagttggagtgcaaagccatgatttggtcgatgcggcaaatgttgcttaggactattctatggtcttgcgtaattgtgaagatttgccagttatctaaggagacgtggtg

SEQ ID NO: 86 - DNA, 686 bp, Artificial Sequence
  transcript variant
gctacgtggtggatgaacatggatgcgaacgacatttcgaaatatacgcaatgatatccaaccctaccgaaacagcaataattgtagaaggtagcatatcatgccgagtcatcgacatgcctttatcgacacacgacgtgattggagtttactacgttgtagcgagtttagttgaaatagtttgtgatgtgtaaactaaaacataccaaatggtaaaacttgtcacccccatttacattgcgacagacacagttatggagtggatggaagtgtgttcgactgtcaagacccttctataatagtcgaaccagtacggtaagtgggcaacatgcccatataagtcgaagcatttcaaatggttcatccagtagacgacgatgtcctagacagtcatgtctcttccccatttgaagtcatgtagtggttgtctactttttcattgaagacgtccacctcaacgctatgaacgttagttgagacaatgttaaagcaaacgacaacgtcattgtgatctacatacacagtggatggttagcgtaaacatggtggaacgtactttgactgcgctgcaagaaatggttgggtcgatcgtaatgctagtcgttacatcggaacaagccaaaacaaatcattcgctggatttagacctactgcacgacgacgtcgacacaagacattcttgaaag

SEQ ID NO: 87 - DNA, 740 bp, Artificial Sequence
  transcript variant
gtaaaacttgtcacccccatttacattgcgacagacacagttatggagtggatggaagtgtgttcgactgtcaagacccttctataatagtcgaaccagtacggtaagtgggcaacatgcccatataagtcgaagcatttcaaatggttcatccagtagacgacgatgtcctagacagtcatgtctgtcacatctatcacgcctcctacgttgtgccataacgaagaataatagtgataagagacatcgaagctgtcgtagtcgttcgctaaattgcttacaatttagtgctctaagtgaacaatgtttcatcttgagaagcaaacgaagtagaagttgacgacgcattcgaagacgtggacaatgtgacacgagtatcgaaacatgatccaacgaacatcgaagaagttactactgaactacgggtcagcttccccatttgaagtcatgtagtggttgtctactttttcattgaagacgtccacctcaacgctatgaacgttagttgagacaatgttaaagcaaacgacaacgtcattgtgatctacatacacagtggatggttagcgtaaacatggtggaacgtactttgactgcgctgcaagaaatggttgggtcgatcgtaatgctagtcgttacatcggaacaagccaaaacaaatcattcgctggatttagacctactgcacgacgacgtcgacacaagacattcttgaaaggtaattgacgtggacgtttcag

SEQ ID NO: 88 - DNA, 523 bp, Artificial Sequence
  transcript variant
gccgcatcgaccaaatcatggctttgcactccaactttgcctgaatcgtgtcagactatagcgggacgttcgaccatactactcattcgattacgcattcacctgacgagaatagccattcttcctgaacatacgttagaagtagttggttaatgcttgtctacatttgagtgcgaagccactaggtttgcactgttgaccaccagcacgcaatcgcaagatacgcagtaatgctaaaccatacttatttgactttgatgttctatcactgggttaatgcctgctgctacctgacttttagtcgcgagcacaacgcttcttggctacacatatgctgttgggaatgttttttacacttattatgctataaataccactcccacagctattcgaatgactctaatacctcttgcaacttggacgaccgtagtacgcattcagtccgagtaccaagataatgctctttcttctgccactcgtctaacttcgtcggctccgtgaacaagcattcttcctactaggc

SEQ ID NO: 89 - DNA, 424 bp, Artificial Sequence
  transcript variant
gttgaggtggacgtcttcaatgaaaaagtagacaaccactacatgacttcaaatggggaagctgacccgtagttcagtagtaacttcttcgatgttcgttggatcatgtttcgatactcgtgtcacattgtccacgtcttcgaatgcgtcgtcaacttctacttcgtttgcttctcaagatgaaacattgttcacttagagcactaaattgtaagcaatttagcgaacgactacgacagcttcgatgtctcttatcactattattcttcgttatggcacaacgtaggaggcgtgatagatgtgacagacatgactgtctaggacatcgtcgtctactggatgaaccatttgaaatgcttcgacttatatgggcatgttgcccacttaccgtactggttcgactattatagaagggtcttgacag

SEQ ID NO: 90 - DNA, 2467 bp, Artificial Sequence
  transcript variant
gtggagaagcaaatacttggataccgaatttagaggccataggttatggaaaaagtcagtggattagatagtaaaagtcgaaatctttatattcggttcgatgtactacgttattcgcgactgttctgtcatgatagttttttatatagtcctaataaaaggagtttttaaagtaaatgacatttcagtagtaaaagtttaagagctttttgttctgccagacgttctgatagttgaggaaaacgtgtggtcagctaataacttgtggtatggagtaaacgaacatccaacagtatgtacaatcgtatgagaaaggacaaatctgaagacgatattagagggagtccaacaagtttgtgatgattcacgtaaggaaatcgaaatgtaagattattcgtcaatggaggtataagacaacacaccaagtaattatacgcgacgagttttcatgttgacgatccctgagactatatcatacaaaattgacccaaataataaactcgttccaatagttgaagtgttgattaacacattgagacaagttgtccgtactttaatcatcaaagttttggactgacctataaatgaaatattcgcgttgtcttcagtttaagaagtgatattattttcggtttcaagcctatgtggagagatacaggaaataggtaaactataactaatataaatatacgcagacgaagcctgttaactttaccaaatccaaatagcgggagacactaaacttacaagaaatgtacggtaagacagggaaacagggtttgaagtttggaggtacaaaatcttaatccttcacaactgaatcaacatttacattcggttacgttcggggtttgtagtagtaattgttgaggtaattttaattgcacttacagacgtggatttggtgaaacattatgtggtagattcatatttccgaatcttaatagacgattttatgatggtgatcgtggtttcttttcaaggtttggtggacgaaaatgaaaaaatcacaatttaacgtttcatattcatcacaatccgaaatcgagatggagagaaagtttgactaaactttgttacagtatttttgaaggcaatcaacctggaactttggatttcatcaagtaaacacccatatttagcgaaaatgcaagctaactgcgaactaacaaggtaactctttttcgatttcaaaatatggtcagtagcaatatgttaagtgatccattttggaggggtggggatttgttcaatgaatgaggcaataaaccaccgcaacctctgtaattgacgagaaacttgtataaggtcatcaaaaagaatagatgaacataaagattgaatacggctgggtgaggttaattcagatttcccaaattatgtagatgaaaagatggtaagtttattgataggtaaaaaatcaagagagggtaataaagaagaaagaataatcaaaagatagagcatgcaaacattacatggtagtattgttataggcggtatattggtaaatgacgatccttgacttagttttttacatcgaacggttgcaaatcctagcatacttgatattaatagtagatactgaaatatatctgagtatatcaagggaaatcgagatgtaacaataagtcgaggaaattaaggtcaatttagtgcttatcatagaaataactacttaagcccttaacgaactaactcaaattaacgaggtagaggttattctgaattgtacgaacgtagtcgaagtttgttaccaagggtaaagccaaaacaaaacgatttgacaagagaatctattccatgtagtagtgcgtttgtacgacgttctattcgatgtaaatcattaggacgagggtttgaagcaactcggaaagatggtcggttagaatttaaaagtactgaacggaattaacgaagttggctactacctaatagtctttgcttaggatttagtagttcgcaattgggtcaaagtggtcgctttggtcgtcgacgtcaagactcaacaagtcatttaccgctgtacgaaccatctcatttaacaggttctcaaccaaatagcggtaggagtagaaagcacttaccatcgtacgaactttgacaacgaaaggttcaaaggtaaccaaggcgtagtagtgagttaggtcaatgtataaaaactccctttcttattttgagtcgtcaatgtagtcgagaaagtatgcacttagtgccattattattagacaagatagtccgttctttagtcgaagttcttgttgtaataacaaaagtagagcagattacgatccgaaatttcatggacacagatatttgagatcaacatttgattcgttgacgtatttatgttgattcggttagcgagagttacaaagttagtaatagaaagaaagaggaaataataatcaaaagattaagcatgcaaacattaagaggacacatatgtattggtggcatttgcgtt

SEQ ID NO: 91 - DNA, 1807 bp, Artificial Sequence
  transcript variant
gataccgaatttagaggccataggttatggaaaaagtcagtggagtaaacgaacatccaacagtatgtacaatcgtatgagaaaggacaaatctgaagacgatattagagggagtccaacaagtttgtgatgattcacgtaaggaaatcgaaatgtaagattattcgtcaatggaggtataagacaacacaccaagtaattatacgcgacgagttttcatgttgacgatccctgagactatatcatacaaaattgacccaaataataaactcgttccaatagttgaagtgttgattaacacattgagacaagttgtccgtactttaatcatcaaagttttggactgacctataaatgaaatattcgcgttgtcttcagtttaagaagtgatattattttcggtttcaagcctatgtggagagatacaggaaataggtaaactataactaatataaatatacgcagacgaagcctgttaactttaccaaatccaaatagcgggagacactaaacttacaagaaatgtacggtaagacagggaaacagggtttgaagtttggaggtacaaaatcttaatccttcacaactgaatcaacatttacattcggttacgttcggggtttgtagtagtaattgttgaggtaattttaattgcacttacagacgtggatttggtgaaacattatgtggtagattcatatttccgaatcttaatagacgattttatgatggtgatcgtggtttcttttcaaggtttggtggacgaaaatgaaaaaatcacaatttaacgtttcatattcatcacaatccgaaatcgagatggagagaaagtttgactaaactttgttacagtatttttgaaggcaatcaacctggaactttggatttcatcaagtaaacacccatatttagcgaaaatgcaagctaactgcgaactaacaaggtaactctttttcgatttcaaaatatggtcagtagcaatatgttaagtgatccattttggaggggtggggatttgttcaatgaatgaggcaataaaccaccgcaacctctgtaattgacgagaaacttgtataaggtcatcaaaaagaatagatgaacataaagattgaatacggctgggtgaggttaattcagatttcccaaattatgtagatgaaaagatggtaagtttattgataggtaaaaaatcaagagagggtaataaagaagaaagaataatcaaaagatagagcatgcaaacattacatggtagtattgttataggcggtatattggtaaatgacgatccttgacttagttttttacatcgaacggttgcaaatcctagcatacttgatattaatagtagatactgaaatatatctgagtatatcaagggaaatcgagatgtaacaataagtcgaggaaattaaggtcaatttagtgcttatcatagaaataactacttaagcccttaacgaactaactcaaattaacgaggtagaggttattctgaattgtacgaacgtagtcgaagtttgttaccaagggtaaagccaaaacaaaacgatttgacaagagaatctattccatgtagtagtgcgtttgtacgacgttctattcgatgtaaatcattaggacgagggtttgaagcaactcggaaagatggtcggttagaatttaaaagtactgaacggaattaacgaagttggctactacctaatagtctttgcttaggatttagtagttcgcaattgggtcaaagtggtcgctttggtcgtcgacgtcaagactcaacaagtcatttaccgctgtacgaaccatc

SEQ ID NO: 92 - DNA, 2018 bp, Artificial Sequence
  transcript variant
gataccgaatttagaggccataggttatggaaaaagtcagtggattagatagtaaaagtcgaaatctttatattcggttcgatgtactacgttattcgcgactgttctgtcatgatagttttttatatagtcctaataaaaggagtttttaaagtaaatgacatttcagtagtaaaagtttaagagctttttgttctgccagacgttctgatagttgaggaaaacgtgtggtcagctaataacttgtggtatggagtaaacgaacatccaacagtatgtacaatcgtatgagaaaggacaaatctgaagacgatattagagggagtccaacaagtttgtgatgattcacgtaaggaaatcgaaatgtaagattattcgtcaatggaggtataagacaacacaccaagtaattatacgcgacgagttttcatgttgacgatccctgagactatatcatacaaaattgacccaaataataaactcgttccaatagttgaagtgttgattaacacattgagacaagttgtccgtactttaatcatcaaagttttggactgacctataaatgaaatattcgcgttgtcttcagtttaagaagtgatattattttcggtttcaagcctatgtggagagatacaggaaataggtaaactataactaatataaatatacgcagacgaagcctgttaactttaccaaatccaaatagcgggagacactaaacttacaagaaatgtacggtaagacagggaaacagggtttgaagtttggaggtacaaaatcttaatccttcacaactgaatcaacatttacattcggttacgttcggggtttgtagtagtaattgttgaggtaattttaattgcacttacagacgtggatttggtgaaacattatgtggtagattcatatttccgaatcttaatagacgattttatgatggtgatcgtggtttcttttcaaggtttggtggacgaaaatgaaaaaatcacaatttaacgtttcatattcatcacaatccgaaatcgagatggagagaaagtttgactaaactttgttacagtatttttgaaggcaatcaacctggaactttggatttcatcaagtaaacacccatatttagcgaaaatgcaagctaactgcgaactaacaaggtaactctttttcgatttcaaaatatggtcagtagcaatatgttaagtgatccattttggaggggtggggatttgttcaatgaatgaggcaataaaccaccgcaacctctgtaattgacgagaaacttgtataaggtcatcaaaaagaatagatgaacataaagattgaatacggctgggtgaggttaattcagatttcccaaattatgtagatgaaaagatggtaagtttattgataggtaaaaaatcaagagagggtaataaagaagaaagaataatcaaaagatagagcatgcaaacattacatggtagtattgttataggcggtatattggtaaatgacgatccttgacttagttttttacatcgaacggttgcaaatcctagcatacttgatattaatagtagatactgaaatatatctgagtatatcaagggaaatcgagatgtaacaataagtcgaggaaattaaggtcaatttagtgcttatcatagaaataactacttaagcccttaacgaactaactcaaattaacgaggtagaggttattctgaattgtacgaacgtagtcgaagtttgttaccaagggtaaagccaaaacaaaacgatttgacaagagaatctattccatgtagtagtgcgtttgtacgacgttctattcgatgtaaatcattaggacgagggtttgaagcaactcggaaagatggtcggttagaatttaaaagtactgaacggaattaacgaagttggctactacctaatagtctttgcttaggatttagtagttcgcaattgggtcaaagtggtcgctttggtcgtcgacgtcaagactcaacaagtcatttaccgctgtacgaaccatc

SEQ ID NO: 93 - DNA, 1083 bp, Artificial Sequence
  transcript variant
gataccgaatttagaggccataggttatggaaaaagtcagtggtacgaattacgaacaccttaacattagggaaacttagatagttgtacaaagtaacgtataacaagtatcgcgtatggattagatagtaaaagtcgaaatctttatattcggttcgatgtactacgttattcgcgactgttctgtcatgatagttttttatatagtcctaataaaaggagtttttaaagtaaatgacatttcagtagtaaaagtttaagagctttttgttctgccagacgttctgatagttgaggaaaacgtgtggtcagctaataacttgtggtatggagtaaacgaacatccaacagtatgtacaatcgtatgagaaaggacaaatctgaagacgatattagagggagtccaacaagtttgtgatgattcacgtaaggaaatcgaaatgtaagattattcgtcaatggaggtataagacaacacaccaagtaattatacgcgacgagttttcatgttgacgatccctgagactatatcatacaaaattgacccaaataataaactcgttccaatagttgaagtgttgattaacacattgagacaagttgtcctattgttataggcggtatattggtaaatgacgatccttgacttagttttttacatcgaacggttgcaaatcctagcatacttgatattaatagtagcatcgtacgaactttgacaacgaaaggttcaaaggtaaccaaggcgtagtagtgagttaggtcaatgtataaaaactccctttcttattttgagtcgtcaatgtagtcgagaaagtaagatgcacttagtgccattattattagacaagatagtccgttctttagtcgaagttcttgttgtaataacaaaagtagagcagattacgatccgaaatttcatggacacagatatttgagatcaacatttgattcgttgacgtatttatgttgattcggttagcgagagttacaaagttagtaatagaaagaaagaggaaataataatcaaaagattaagcatgcaaacattaagaggacacatatgtattggtggcatttgcg

SEQ ID NO: 94 - DNA, 436 bp, Artificial Sequence
  transcript variant
gtacgaattacgaacaccttaacattagggaaacttagatagttgtacaaagtaacgtataacaagtatcgcgtatggattagatagtaaaagtcgaaatctttatattcggttcgatgtactacgttattcgcgactgttctgtcatgatagttttttatatagtcctaataaaaggagtttttaaagtaaatgacatttcagtagtaaaagtttaagagctttttgttctgccagacgttctgatagttgaggaaaacgtgtggtcagctaataacttgtggtatgtttggaggtacaaaatcttaatccttcacaactgaatcaacatttacattcggttacgttcggggtttgtagtagtaattgttgaggtaattttaattgcacttacagacgtggatttggtgaaacattatgtggtagattcatattt

SEQ ID NO: 95 - DNA, 2373 bp, Artificial Sequence
  transcript variant
gtggagaagcaaatacttggataccgaatttagaggccataggttatggaaaaagtcagtggtacgaattacgaacaccttaacattagggaaacttagatagttgtacaaagtaacgtataacaagtatcgcgtatggagtaaacgaacatccaacagtatgtacaatcgtatgagaaaggacaaatctgaagacgatattagagggagtccaacaagtttgtgatgattcacgtaaggaaatcgaaatgtaagattattcgtcaatggaggtataagacaacacaccaagtaattatacgcgacgagttttcatgttgacgatccctgagactatatcatacaaaattgacccaaataataaactcgttccaatagttgaagtgttgattaacacattgagacaagttgtccgtactttaatcatcaaagttttggactgacctataaatgaaatattcgcgttgtcttcagtttaagaagtgatattattttcggtttcaagcctatgtggagagatacaggaaataggtaaactataactaatataaatatacgcagacgaagcctgttaactttaccaaatccaaatagcgggagacactaaacttacaagaaatgtacggtaagacagggaaacagggtttgaagtttggaggtacaaaatcttaatccttcacaactgaatcaacatttacattcggttacgttcggggtttgtagtagtaattgttgaggtaattttaattgcacttacagacgtggatttggtgaaacattatgtggtagattcatatttccgaatcttaatagacgattttatgatggtgatcgtggtttcttttcaaggtttggtggacgaaaatgaaaaaatcacaatttaacgtttcatattcatcacaatccgaaatcgagatggagagaaagtttgactaaactttgttacagtatttttgaaggcaatcaacctggaactttggatttcatcaagtaaacacccatatttagcgaaaatgcaagctaactgcgaactaacaaggtaactctttttcgatttcaaaatatggtcagtagcaatatgttaagtgatccattttggaggggtggggatttgttcaatgaatgaggcaataaaccaccgcaacctctgtaattgacgagaaacttgtataaggtcatcaaaaagaatagatgaacataaagattgaatacggctgggtgaggttaattcagatttcccaaattatgtagatgaaaagatggtaagtttattgataggtaaaaaatcaagagagggtaataaagaagaaagaataatcaaaagatagagcatgcaaacattacatggtagtattgttataggcggtatattggtaaatgacgatccttgacttagttttttacatcgaacggttgcaaatcctagcatacttgatattaatagtagatactgaaatatatctgagtatatcaagggaaatcgagatgtaacaataagtcgaggaaattaaggtcaatttagtgcttatcatagaaataactacttaagcccttaacgaactaactcaaattaacgaggtagaggttattctgaattgtacgaacgtagtcgaagtttgttaccaagggtaaagccaaaacaaaacgatttgacaagagaatctattccatgtagtagtgcgtttgtacgacgttctattcgatgtaaatcattaggacgagggtttgaagcaactcggaaagatggtcggttagaatttaaaagtactgaacggaattaacgaagttggctactacctaatagtctttgcttaggatttagtagttcgcaattgggtcaaagtggtcgctttggtcgtcgacgtcaagactcaacaagtcatttaccgctgtacgaaccatctcatttaacaggttctcaaccaaatagcggtaggagtagaaagcacttaccatcgtacgaactttgacaacgaaaggttcaaaggtaaccaaggcgtagtagtgagttaggtcaatgtataaaaactccctttcttattttgagtcgtcaatgtagtcgagaaagtgtccaagcaaaacgtaacgaaacggttgagtaaggacttgcacactatgcccttgcgggtttacctgcttgacgtagtcctgccacttattatccgtgattgttacctaatggacaacctaatcgttagcttaaagaagatgcacttagtgccattattattagacaagatagtccgttctttagtcgaagttcttgttgtaataacaaaagtagagcagtattttgacgtatagggagacagtcattaggtcattaacccagttactaaggacaacgtaaccatcgaagttattgaacttcag

SEQ ID NO: 96 - DNA, 779 bp, Artificial Sequence
  transcript variant
gataccgaatttagaggccataggttatggaaaaagtcagtggtacgaattacgaacaccttaacattagggaaacttagatagttgtacaaagtaacgtataacaagtatcgcgtatgatagtaaaagtcgaaatctttatattcggttcgatgtactacgttattcgcgactgttctgtcatgatagttttttatatagtcctaataaaaggagtttttaaagtaaatgacatttcagtagtaaaagtttaagagctttttgttctgccagacgttctgatagttgaggaaaacgtgtggtcagctaataacttgtggagtaaacgaacatccaacagtatgtacaatcgtatgagaaaggacaaatctgaagacgatattagagggagtccaacaagtttgtgatgattcacgtaaggaaatcgaaatgtaagattattcgtcaatggaggtataagacaacacaccaagtaattatacgcgacgagttttcatgttgacgatccctgagactatatcatacaaaattgacccaaataataaactcgttccaatagttgaagtgttgattaacacattgagacaagttgtccgattacgatccgaaatttcatggacacagatatttgagatcaacatttgattcgttgacgtatttatgttgattcggttagcgagagttacaaagttagtaatagaaagaaagaggaaataataatcaaaagattaagcatgcaaacattaagaggacacatatgtattggtggcatttgcgtt

SEQ ID NO: 97 - DNA, 479 bp, Artificial Sequence
  transcript variant
ggcctctaaattcggtatccaagtatttgcttctccacctgccaagcgcacataaattctttgcgagtgttgtttggccacttttggtagctcctgtttcttggcaattttggctgacacgttcagtttcttttgctccaacttcgtaagcagttagtgtaggcgtgcgctaaggcattgcgctactcgcttccatcgttggttctaccacccatatgccatggcgtcctgtaagtttgcgcctaattactcgaagcgctttcatttctacgaaacgttttggaataatgtcaacttgggcattgttgaaactacggcttccttaatgctcttgacaaccttgtttagttgttgttcttccttcttccagcatttaataaccggcttttgttttaactccttcgctttttcgactttctcctttagcaccgcaacgttctttttaagctacaacgctttcttgaaatgcttctcgtcat

SEQ ID NO: 98 - DNA, 796 bp, Artificial Sequence
  transcript variant
gtattagggcgcattgcgctttgccgaacgcgtaattacagaacttgtggtttcggttttgtcgatagcgactggaactgccgaactttgtttaataattacacgttaatctgggacaaaaggcaagctgaagatcgcagtaacagttggttctgcgaaagttgaccaacctatgcgactttctggttttgcctgttatgaacaacgttggcaggtaaagaagcggctgactgctggtcgaagagccaaatggtcaacattagcatagcttgtttcgtaatcgattggctcaactgccgccgtgtccacgcgttaaacgcggttagtaacatccactgaactttcttcgccaacagtacaagctggcagttgcatgtctttagtacaggagattgcaacgctacctacgcaagctttgactgcgatgctacaccgcacgatagctcgcgtacctacacttttacgcgctactactccgcgaacataagccacttcatgttgaacgaatggagaacgttatggttcacttctttatgcgaccgaagaaggcgcagtgtttgcttgacaatttactgtcgtgtcttcggtaacagatatgctaccaagcgacctaaccactttaagcagcttcaccgtcttacgagacgttaacctaacgcaaatgccaccaatacatatgtgtcctcttaatgtttgcatgcttaatcttttgattattatttcctctttctttctattactaactttgtaactctcgctaaccgaatcaacataaatacgtcaacgaatcaaatgt

SEQ ID NO: 99 - DNA, 589 bp, Artificial Sequence
  transcript variant
gcgtaattacagaacttgtggtttcggttttgtcgatagcgactggaactgccgaactttgtttaataattacacgttaatctgggacaaaaggcaagctgaagatcgcagtaacagttggttctgcgaaagttgaccaacctatgcgactttctggttttgcctgttatgaacaacgttggcaggtaaagaagcggctgactgctggtcgaagagccaaatggtcaacattagcatagcttgtttcctctttttcgttgcggagttaagtaggagaacgttatggttcacttctttatgcgaccgaagaaggcgcagtgtttgcttgacaatttactgtcgtgtcttcggtaacagatatgctaccaagcgacctaaccaccttcaccgtcttacgagacgttaacctaacgcaaatgccaccaatacatatgtgtcctcttaatgtttgcatgcttaatcttttgattattatttcctctttctttctattactaactttgtaactctcgctaaccgaatcaacataaatacgtcaacgaatcaaatgttgatctcaaatatctgtgtccatgaaatttcggatcgt

SEQ ID NO: 100 - DNA, 161 bp, Artificial Sequence
  transcript variant
gctgaccacacgttttcctcaactatcagaacgtctggcagaacaaaaagctcttaaacttttactactgaaatgtcatttactttaaaaactccttttattaggactatataaaaaactatcatgacagaacagtcgcgaataacgtagtacatcgaacc

SEQ ID NO: 101 - DNA, 2253 bp, Artificial Sequence
  transcript variant
gttgaacttatacagaaatactaaaagtcgaacaaccattcgatttaggaatacagaacgataacgcagcagaagtagttgaccaccgtgtaacttgaatggtgatggtcctggttctattaatacaaatccttttacttatgctccgtgatacagaacaactaaaagaactaaaagagaagaacgacgtgcacgtgctaattatgcgaattaacatcgggttagaaaaagtaaactaaaggaaaatgggtaaggcatatgccttactaaattgtgtaaaagaagttctaataagaaccggaatgtatgtaattattcgcaagggttccataaggcacatatacaaatttagaaacaacccgttacattaacaaaggtgaacggtgtttcacagatattagaccattaggtaaccaatgacatttcactatcgaaaagggtatagtattaactactacaactaatccgactcgtcgaggtgatttatacaggactgcaggtagcaaacgacgaggtggacgagggtaaggtggccgacgaaagggaggacatgcacctagttgaacacgactaggaggacgatggccactacggagtggaacacaaaggtaaagttgcaataataaccagtacaacaaaagcatacgtggaaggtgacaagcaaacgatgtcttgaacaacaccgtcttcattgtttaccatttgctgttggatttgatatttagagcgtatgttgaagaagttggaactctggacacattagagacttattggatcgatcaagaggaatgcaatacgaagtagtttcactttcgtaggttaccctataacacgcaaatagatgtaatcaacctcttattaatcatacactagacatcagatgttaatgacctaacgattatagtgctgaacaacgtctacgacaatataaacctttgcaaagactggtcaaacatcaatgttaaacacgtccagataaaagcaaaaaggtaagacgaggattacggaataattaatatagtgcttgttccaatcggcccggcttcagtcattcccggtggcgaagccataacatttaaaaatagcctgttaacttcaagctgtagtagcctaaacaggtttcctaatagtatgcaaacaacatagttcaatagaagttattaataaacatcaaattgtctttgaacaacacaaacacgtaagctttcggcaactaaattaactaaaaaataactataattacacagaacacgaagtcatctgtttcctattaaaaaataggtacttgacaggttacaatataacctgtttctagcatgtataacaaaattaagcgacgaccgagcgacgacaacaagcagcagccaggtgggcaaaaggctaagactgctttgatgtcctgagccaacttgccgatacgcagcaacattttagaaacgtcatcctgaccgccgccgccattgccataaatgatagcttggcggtagccgcccaaaactatgaaaaaaattaaattaaggaaagacataaacaaggtagttaagccatgcacctagaaaattttgaacggctcagctgcaacatattagcgctagaaatgacctaccataatgatatagaagataattaccattactgccaccgcctcctccgctgccgcctcctccatagcagcttctattcaaacaaactccgccgccgccaccgccgccataaccaccaccataaccaccgccgtatacacaaacgccgctccttctaagtcttagctattaataacaaccgtggaaacaaaaaacgtaatataggctacagctgtgtcaacagccaaatccataacaacaaaatccatggtgactgtaacagacactgttacaaccatattattaactagatagtggttacagataatcatgcagcaacaacatataaagaagacggttaaagttattgacttatgttagcatgtgcaaattaacataggctagtcttaacctgactcgctgtcgcgactggcatgcaaagtttgacacgccgcggctctagtacgcgtcatctttcagctgtaataactacaaacacatcaaaaaaagtcggtttaaaacaacttgtgaaacgtcaacttggtaaataaacctattattaaagaatctagatcaatgtccaaaaagattatttccattgttacgtctaaatacagattctgcgaaaacaagccattagtatagtagaagaactaaccatcgtatgttc

SEQ ID NO: 102 - DNA, 2059 bp, Artificial Sequence
  transcript variant
gtgtaaccatcttacggatgtaatctaacgtaaacaccagagaaacaaccatcaaaacggcataatgggcaagcattattaggaacatctaaatataaaaccattgccttaactcacataacgctacacttggtaacaccaccatatgcagtgcaagaacgttgggtaagagaacatcgaacgtatggtctgtttacataagctcaaaaataattttacagggtaaaacgtcaatcattacttaacagcagtaatgcttacaaatgtttcggttagtatttaaaaccgtaacgaacgccacgtgtaaaaacaagaggttttattaatattgggtatattagatgtatccgtcgattaacccaccataaccaaactaaattaaagcaacgacttatgcgaaatcctccttgtttacaaactaacagtaatgcaagtcgtaataaacgtcttaaatattttataggtaaaagatttggaccatatcctcagtactgtaatgataaacaccgacgaagtctacatcgttgcaacggaaaattccatgaaagtcgtatgttttatggtaaacttccgaatttagcaaaaagggttgtaaaaggtatacgtcatcatggtaagaaatacagctgtattagtatataaggttgtagaaaaccacataataatatgtctttagcactagacatcagatgttaatgacctaacgattatagtgctgaacaacgtctacgacaatataaacctttgcaaagactggtcaaacatcaatgttaaacacgtccagataaaagcaaaaaggtaagacgaggattacggaataattaatatagtgcttgttccaatcggcccggcttcagtcattcccggtggcgaagccataacatttaaaaatagcctgttaacttcaagctgtagtagcctaaacaggtttcctaatagtatgcaaacaacatagttcaatagaagttattaataaacatcaaattgtctttgaacaacacaaacacgtaagctttcggcaactaaattaactaaaaaataactataattacacagaacacgaagtcatctgtttcctattaaaaaataggtacttgacaggttacaatataacctgtttctagcatgtataacaaaattaagcgacgaccgagcgacgacaacaagcagcagccaggtgggcaaaaggctaagactgctttgatgtcctgagccaacttgccgatacgcagcaacattttagaaacgtcatcctgaccgccgccgccattgccataaatgatagcttggcggtagccgcccaaaactatgaaaaaaattaaattaaggaaagacataaacaaggtagttaagccatgcacctagaaaattttgaacggctcagctgcaacatattagcgctagaaatgacctaccataatgatatagaagataattaccattactgccaccgcctcctccgctgccgcctcctccatagcagcttctattcaaacaaactccgccgccgccaccgccgccataaccaccaccataaccaccgccgtatacacaaacgccgctccttctaagtcttagctattaataacaaccgtggaaacaaaaaacgtaatataggctacagctgtgtcaacagccaaatccataacaacaaaatccatggtgactgtaacagacactgttacaaccatattattaactagatagtggttacagataatcatgcagcaacaacatataaagaagacggttaaagttattgacttatgttagcatgtgcaaattaacataggctagtcttaacctgactcgctgtcgcgactggcatgcaaagtttgacacgccgcggctctagtacgcgtcatctttcagctgtaataactacaaacacatcaaaaaaagtcggtttaaaacaacttgtgaaacgtcaacttggtaaataaacctattattaaagaatctagatcaatgtccaaaaagattatttccattgttacgtctaaatacagattctgcgaaaacaagccattagtatagtagaagaactaaccatcgtatg

SEQ ID NO: 103 - DNA, 670 bp, Artificial Sequence
  transcript variant
gtgaaaggtgatacatatttacttgacttcttaagcagagagcgtcaaaacaggttgaacttatacagaaatactaaaagtcgaacaaccattcgatttaggagtgcagatacagaacaactaaaagaactaaaagagaagaacgacgtgcacgtgctaattatgcgaattaacatcgggttagaaaaagtaaactaaaggaaaatgggtaaggcatatgccttactaaattgtgtaaaagaagttctaataagaaccggaatgtatgtaattattcgcaagggttccataaggcacatatacaaatttagaaacaacccgttacattaacaaaggtgaacggtgtttcacagatattagaccattaggtaaccaatgacatttcactatcgaaaagggtatagtattaactactacaactaatccgactcgtcgaggtgatttatacaggactgcaggtagcaaacgacgaggtggacgagggtaaggtggccgacgaaagggaggacatgcacctagttgaacacgactaggaggacgatggccactacggagtggaacacaaaggtaaagttgcaataataaccagtacaacaaaagcatacgtggaaggtgacaagcaaacgatgtcttgaacaacaccgtcttcattgtttaccatttgctgttg

SEQ ID NO: 104 - DNA, 592 bp, Artificial Sequence
  transcript variant
gcaattaggatcaggtggttaatctgatacgatacagaacaactaaaagaactaaaagagaagaacgacgtgcacgtgctaattatgcgaattaacatcgggttagaaaaagtaaactaaaggaaaatgggtaaggcatatgccttactaaattgtgtaaaagaagttctaataagaaccggaatgtatgtaattattcgcaagggttccataaggcacatatacaaatttagaaacaacccgttacattaacaaaggtgaacggtgtttcacagatattagaccattaggtaaccaatgacatttcactatcgaaaagggtatagtattaactactacaactaatccgactcgtcgaggtgatttatacaggactgcaggtagcaaacgacgaggtggacgagggtaaggtggccgacgaaagggaggacatgcacctagttgaacacgactaggaggacgatggccactacggagtggaacacaaaggtaaagttgcaataataaccagtacaacaaaagcatacgtggaaggtgacaagcaaacgatgtcttgaacaacaccgtcttcattgtttaccatttgctgttg

SEQ ID NO: 105 - DNA, 626 bp, Artificial Sequence
  transcript variant
gccaaggtgaaccaggacgaagtcgatgtttcagaacctcctttaggccttttagacggtttaaacgaagcactagaccaagtaataaaagcggacgttgcacaggtacgtgcagatacagaacaactaaaagaactaaaagagaagaacgacgtgcacgtgctaattatgcgaattaacatcgggttagaaaaagtaaactaaaggaaaatgggtaaggcatatgccttactaaattgtgtaaaagaagttctaataagaaccggaatgtatgtaattattcgcaagggttccataaggcacatatacaaatttagaaacaacccgttacattaacaaaggtgaacggtgtttcacagatattagaccattaggtaaccaatgacatttcactatcgaaaagggtatagtattaactactacaactaatccgactcgtcgaggtgatttatacaggactgcaggtagcaaacgacgaggtggacgagggtaaggtggccgacgaaagggaggacatgcacctagttgaacacgactaggaggacgatggccactacggagtggaacacaaaggtaaagttgcaataataaccagtacaacaaaagcatacgtggaaggtgacaag

SEQ ID NO: 106 - DNA, 617 bp, Artificial Sequence
  transcript variant
gacatcagatgttaatgacctaacgattatagtgctgaacaacgtctacgacaatataaacctttgcaaagactggtcaaacatcaatgttaaacacgtccagataaaagcaaaaaggtaagacgaggattacggaataattaatatagtgcttgttccaatcggcccggcttcagtcattcccggtggcgaagccatgtcaccaataaaaactatcggcggcaatggaagtggtttttcggaaactgttacgggtgcaagcggccccagtgcagtttgtgccttgccaatcggcccagctttcaaacgcaaagttggacgacttattggcccattctgacaacgtcctgttaaactgcccggacgttcaaacggcggtatcggacgactaacgcgttacggcggacaactcgcccccagtcaacaacttggacacggtaaatttgaacgctaagtcaactgtagcagttaaacattgagtattaaaatagatttaagctagcgttaagaacattaaaaactaaccagccaaaccaaggattacggctgtggtgtaatcgattgcgaaatagcatgacaaaaaacttacagtttagaaggtggcggtattacttaag

SEQ ID NO: 107 - DNA, 2105 bp, Artificial Sequence
  transcript variant
gcagatacagaacaactaaaagaactaaaagagaagaacgacgtgcacgtgctaattatgcgaattaacatcgggttagaaaaagtaaactaaaggaaaatgggtaaggcatatgccttactaaattgtgtaaaagaagttctaataagaaccggaatgtatgtaattattcgcaagggttccataaggcacatatacaaatttagaaacaacccgttacattaacaaaggtgaacggtgtttcacagatattagaccattaggtaaccaatgacatttcactatcgaaaagggtatagtattaactactacaactaatccgactcgtcgaggtgatttatacaggactgcaggtagcaaacgacgaggtggacgagggtaaggtggccgacgaaagggaggacatgcacctagttgaacacgactaggaggacgatggccactacggagtggaacacaaaggtaaagttgcaataataaccagtacaacaaaagcatacgtggaaggtgacaagcaaacgatgtcttgaacaacaccgtcttcattgtttaccatttgctgttggatttgatatttagagcgtatgttgaagaagttggaactctggacacattagagacttattggatcgatcaagaggaatgcaatacgaagtagtttcactttcgtaggttaccctataacacgcaaatagatgtaatcaacctcttattaatcatacactagacatcagatgttaatgacctaacgattatagtgctgaacaacgtctacgacaatataaacctttgcaaagactggtcaaacatcaatgttaaacacgtccagataaaagcaaaaaggtaagacgaggattacggaataattaatatagtgcttgttccaatcggcccggcttcagtcattcccggtggcgaagccataacatttaaaaatagcctgttaacttcaagctgtagtagcctaaacaggtttcctaatagtatgcaaacaacatagttcaatagaagttattaataaacatcaaattgtctttgaacaacacaaacacgtaagctttcggcaactaaattaactaaaaaataactataattacacagaacacgaagtcatctgtttcctattaaaaaataggtacttgacaggttacaatataacctgtttctagcatgtataacaaaattaagcgacgaccgagcgacgacaacaagcagcagccaggtgggcaaaaggctaagactgctttgatgtcctgagccaacttgccgatacgcagcaacattttagaaacgtcatcctgaccgccgccgccattgccataaatgatagcttggcggtagccgcccaaaactatgaaaaaaattaaattaaggaaagacataaacaaggtagttaagccatgcacctagaaaattttgaacggctcagctgcaacatattagcgctagaaatgacctaccataatgatatagaagataattaccattactgccaccgcctcctccgctgccgcctcctccatagcagcttctattcaaacaaactccgccgccgccaccgccgccataaccaccaccataaccaccgccgtatacacaaacgccgctccttctaagtcttagctattaataacaaccgtggaaacaaaaaacgtaatataggctacagctgtgtcaacagccaaatccataacaacaaaatccatggtgactgtaacagacactgttacaaccatattattaactagatagtggttacagataatcatgcagcaacaacatataaagaagacggttaaagttattgacttatgttagcatgtgcaaattaacataggctagtcttaacctgactcgctgtcgcgactggcatgcaaagtttgacacgccgcggctctagtacgcgtcatctttcagctgtaataactacaaacacatcaaaaaaagtcggtttaaaacaacttgtgaaacgtcaacttggtaaataaacctattattaaagaatctagatcaatgtccaaaaagattatttccattgttacgtctaaatacagattctgcgaaaacaagccattagtatagtagaagaactaaccatcgtatgt

SEQ ID NO: 108 - DNA, 570 bp, Artificial Sequence
  transcript variant
gtgaaaggtgatacatatttacttgacttcttaagcagagagcgtcaaaacaggttgaacttatacagaaatactaaaagtcgaacaaccattcgatttaggagtgcagatacagaacaactaaaagaactaaaagagaagaacgacgtgcacgtgctaattatgcgaattaacatcgggttagaaaaagtaaactaaaggaaaatgggtaaggcatatgccttactaaattgtgtaaaagaagttctaataagaaccggaatgtatgtaattattcgcaagggttccataaggcacatatacaaatttagaaacaacccgttacattaacaaaggtgaacggtgtttcacagatattagaccattaggtaaccaatgacatttcactatcgaaaagggtataggaggacatgcacctagttgaacacgactaggaggacgatggccactacggagtggaacacaaaggtaaagttgcaataataaccagtacaacaaaagcatacgtggaaggtgacaagcaaacgatgtcttgaacaacaccgtcttcattgtttaccatttgctgtt

SEQ ID NO: 109 - DNA, 1567 bp, Artificial Sequence
  transcript variant
gtgtagcatagcaactgttctgaatgtgatattcggtcaggccacgttgacacttaccaaagcaagacagaaggaagttgacgggacaatagggaagattggcaaagggatttaaacatagtccagttcgcgtggtgaatgacagattgctactgttaccattggcgatactacgttggcgactttacttgcctcggtagcgacagaacaagtgtcgtctacgcaacgaacaaccagcgtgttagctgcaatgtcccctgtagaagaccctcttctttctcttctgaatgatgtagctgtggatagagcgtctcccacgttagggtctagcaaccctccggtggtgtgtggtttcggttcgcttggttgggtgcccaatttccagtaccgaagaggtaattgcaacttcaattgcttagttgacgtgacctttcgggtgtcatggactaccgacggtatctcatacgtgacctcgttgttgacctcgttcttcatctgcacagactacaacgttaggactacggaaccagtgtgaagttgacggacgcgctagaagtctgacactgaccatgcttgtggcaatcgttgttcatgtagccactttgactcgacgttcacgaacatacgatggttagttcttctactatactaatggcttgttttcgcagaatctgtatttagacgtaacaatggaaataatctttttggacattgatctagattctttaataataggtttatttaccaagttgacgtttcacaagttgttttaaaccgactttttttgatgtgtttgtagttattacagctgaaagatgacgcgtactagagccgcggcgtgtcaaactttgcatgccagtcgcgacagcgagtcaggttaagactagcctatgttaatttgcacatgctaacataagtcaataactttaaccgtcttctttatatgttgttgctgcatgattatctgtaaccactatctagttaataatatggttgtaacagtgtctgttacagtcaccatggattttgttgttatggatttggctgttgacacagctgtagcctatattacgttttttgtttccacggttgttattaatagctaagacttagaaggagcggcgtttgtgtatacggcggtggttatggtggtggttatggcggcggtggcggcggcggagtttgtttgaatagaagctgctatggaggaggcggcagcggaggaggcggtggcagtaatggtaattatcttctatatcattatggtaggtcatttctagcgctaatatgttgcagctgagccgttcaaaattttctaggtgcatggcttaactaccttgtttatgtctttccttaatttaatttttttcatagttttgggcggctaccgccaagctatcatttatggcaatggcggcggcggtcaggatgacgtttctaaaatgttgctgcgtatcggcaagttggctcaggacatcaaagcagtcttagccttttgcccacctggctgctgcttgttgtcgtcgctcggtcgtcgcttaattttgttatacatgctagaaacagg

SEQ ID NO: 110 - DNA, 950 bp, Artificial Sequence
  transcript variant
gatcgtggcccagtcagtggattacgttgaccatgagtctggctgttcttggttcaccattagctgtggtgacaataacgggcattgtggcaacgatacgtcgtactgcaagtcccactgtaactaagacaattcggattcgaccgatacttggtctggttcgttaacttcgcgtaccttctgctttaccagcaggtcgtcaacgacgagccaccgtaacgagtgtggtttcggttcgcttggttgggtgcccaatttccagtaccgaagaggtaattgcaacttcaattgcttagttgacgtgacctttcgggtgtcatggactaccgacggtatctcatacgtgacctcgttgttgacctcgttcttcatctgcacagactacaacgttaggactacggaaccagtgtgaagttgacggacgcgctagtttacagatgcggtttattggattggttacaacggcaaaggcggagaccactccaactgtcggaagagtacctcttcaaattgccattccaattgctcgtcatggactttccactcttagacgacccgatgaagctagaagtctgacactgaccatgcttgtggcaatcgttgttcatgtagccactttgactcgacgttcacgaacatacgatggttagttcttctactatactaatggcttgttttcgcagaatctgtatttagacgtaacaatggaaataatctttttggacattgatctagattctttaataataggtttatttaccaagttgacgtttcacaagttgttttaaaccgactttttttgatgtgtttgtagttattacagctgaaagatgacgcgtactagagccgcggcgtgtcaaactttgcatgccagtcgcgacagcgagtcaggttaagactagcctatgttaatttgcacatgctaacataagtcaataactttaaccgtc

SEQ ID NO: 111 - DNA, 1890 bp, Artificial Sequence
  transcript variant
gtagacctttccttgccgcgtggaacaaaccgccatgagtgttttacgtttacggtcggcgaccggagtcacagcgcgaccaacggggccaggcaaaggcccataggcttttccatcggcacgcgaccgattccatcaagtgttaggtgcaatccccattcgggacggacacgcgagtaaaggtctaacatgtttcaactttccagttagtcgccgtcctatattggcaagaccggatggccgtcaaccagttccattctgactatttgccacattgattaaagaagtaggagcgttagtcggcgcgtgcgcgggactatttagcgaaggtcgccgatcgtttgcccgtaaaactaactggcaaaagcctaagtgctgtttcgggtgcaatggtataacttcccacatttagccgaatagcgccaacagcgttattatttggaaccaagcagtgggcgatgtcagcgacaattccactttggtagaggtcgttcttttgtagaaaacaatctaacataactatgacactttcggtaaattcaccacctttaccagggtcgtaagtggtcaagccacgccgaccacttcataagcattggtggaaatcgcatcgacacaataaaagtacaccaaccagcagaaaacaggtacatatacagtttaacgacctggatctaagatgactacagtagcatagccatagaacatggcactgaaatatcgatgggcgtaaaagtgaacaacgcagacgatggattacgacgccaagccactataaatgctaattgagtcgaagaaggtactcctttttggaacacagatattgcagaagcgggaatgaggttgatattacatcaagtatcaacagacgacctcagaagggtggtcttttaaaatgacaacgtacattaagatgcagacaaacactactatgctggatgtgaaaatgtcatatgtgcggcaaaaatagacgacatttaagaacctagcattataggatggagtgttgtattaattcactctagagtaatggatcacggtgccagaaactaaggtggtgtaggactagatgcaagtaacaacggtcgtactaaaatcagctacgcgatcgccgacttagaaggctgagatggagaaacttgtctactggcagacctcactatcttttaggaaggtcacgaagcggctggagtgatggctagtctcagccactgtcaacgggaagcgcgacgtttatggtcaatataaactagcagtttaatccgtatggcgatcttagcggatgttacaggatggagaagatgacaaagtagaagctagacaactatatcaaatcgttgtgtggtcttaaaccgacacagtagcattcatcgttggatgtggaaggtcacagcctcgttggaggagatactacggtcccgcttttcgtgggtgacaaaggtcgcaaaggtttccttagggaggtcgtttcccggatctttatctacatctcctgggtgaaggggatgatctttctctacatagattgcagagagccaggtcaaatacattgagaaatctgtatatgtactttggtaacgctctaaggtaggtacacgttagtgatataaaaagaaggcgacgacgaacttaaattgttagagcagtttatgggtggtaggttacatctatttacttcaaaacgcggtgccctagcccacaagcattgctttgtaaaattgttgaaggtaacttgtaaaagccgaacatgaacgatggatagtagaccgggaagaccaacgttttttcactactccgaaagaacacactgaagggaacggtgtaggttcggtgagtccgggactaggtgtccatgtcggagacctcagtggtgacgtcctcgtagtatag

SEQ ID NO: 112 - DNA, 1984 bp, Artificial Sequence
  transcript variant
gacttgtaggcccatgaattacccgcttaggcaatgggtagacctttccttgccgcgtggaacaaaccgccatgagtgttttacgtttacggtcggcgaccggagtcacagcgcgaccaacggggccaggcaaaggcccataggcttttccatcggcacgcgaccgattccatcaagtgttaggtgcaatccccattcgggacggacacgcgagagcgttagtcggcgcgtgcgcgggactatttagcgaaggtcgccgtatcgcgggtggcggcgtttccgccataacaacaagcgtttaaggtcagagtccgcgacgaatgaaacgccgtgcaagcggctttggtacggccagtttagccaaagcctgatccgttcgccttgggttatcatgtaccagtcaagcggtcatcgcgggcggcgttatcatggatcgtttgcccgtaaaactaactggcaaaagcctaagtgctgtttcgggtgcaatggtataacttcccacatttagccgaatagcgccaacagcgttattatttggaaccaagcagtgggcgatgtcagcgacaattccactttggtagaggtcgttcttttgtagaaaacaatctaacataactatgacactttcggtaaattcaccacctttaccagggtcgtaagtggtcaagccacgccgaccacttcataagcattggtggaaatcgcatcgacacaataaaagtacaccaaccagcagaaaacaggtacatatacagtttaacgacctggatctaagatgactacagtagcatagccatagaacatggcactgaaatatcgatgggcgtaaaagtgaacaacgcagacgatggattacgacgccaagccactataaatgctaattgagtcgaagaaggtactcctttttggaacacagatattgcagaagcgggaatgaggttgatattacatcaagtatcaacagacgacctcagaagggtggtcttttaaaatgacaacgtacattaagatgcagacaaacactactatgctggatgtgaaaatgtcatatgtgcggcaaaaatagacgacatttaagaacctagcattataggatggagtgttgtattaattcactctagagtaatggatcacggtgccagaaactaaggtggtgtaggactagatgcaagtaacaacggtcgtactaaaatcagctacgcgatcgccgacttagaaggctgagatggagaaacttgtctactggcagacctcactatcttttaggaaggtcacgaagcggctggagtgatggctagtctcagccactgtcaacgggaagcgcgacgtttatggtcaatataaactagcagtttaatccgtatggcgatcttagcggatgttacaggatggagaagatgacaaagtagaagctagacaactatatcaaatcgttgtgtggtcttaaaccgacacagtagcattcatcgttggatgtggaaggtcacagcctcgttggaggagatactacggtcccgcttttcgtgggtgacaaaggtcgcaaaggtttccttagggaggtcgtttcccggatctttatctacatctcctgggtgaaggggatgatctttctctacatagattgcagagagccaggtcaaatacattgagaaatctgtatatgtactttggtaacgctctaaggtaggtacacgttagtgatataaaaagaaggcgacgacgaacttaaattgttagagcagtttatgggtggtaggttacatctatttacttcaaaacgcggtgccctagcccacaagcattgctttgtaaaattgttgaaggtaacttgtaaaagccgaacatgaacgatggatagtagaccgggaagaccaacgttttttcactactccgaaagaacacactgaagggaacggtgtaggttcggtgagtccgggactaggtgtccatgtcggagacctcagtggtgacgtcctcgtagtat

SEQ ID NO: 113 - DNA, 526 bp, Artificial Sequence
  transcript variant
gtcacctaaacgtgcgaagtgtgcgaaattaccaccgtaaattcgtcctactgaaagtgcttacgcatcttgagagagattgcagagagccaggtcaaatacattgagaaatctgtatatgtactttggtaacgctctaaggtaggtacacgttagtgatataaaaagaaggcgacgacggtagcagaggtctagaaaccgcatgaacgaccaacttatttgaagagctagtgcggtggaattgggtcggaagaacttaaattgttagagcagtttatgggtggtaggttacatctatttacttcaaaacgcggtgccctagcccacaagcattgctttgtaaaattgttgaaggtaacttgtaaaagccgaacatgaacgatggatagtagaccgggaagaccaacgttttttcactactccgaaagaacacactgaagggaacggtgtaggttcggtgagtccgggactaggtgtccatgtcggagacctcagtggtgacgtcctcgtagtataggtccacgct

SEQ ID NO: 114 - DNA, 2473 bp, Artificial Sequence
  transcript variant
gtccacgctctaagtcgcttgcccaattgtggctaccgcattgctcagaacttcgggtactggccaaccttcaagaagcctagtcttggtgcgtcaccccagtcacgtagcatacccgtcatcatctatggtcgtaggtccaacaatcgtggcgccattgggtaccacttcatcagagctgctcgcatgaccagctatatctggaacatcgctggtgggtcttatggtcgcttttgtgggaaccatcatagtcgcaagtctggccttcggtatggaactcgtcgtcccgactacaaccatagctagtctcggtctcggctttgttgcaatgcccttcgttactacttcaacggtcgtggtgccggtcaaaccgctcgctaaagcaagcgaagaaacagctaaacttagttgtgtcgaaacatcctaagtggtcgggttgctcgtggagcatgcagctagcccagaacctttagcttgtgtggtcttcgtctcggtagtcagaaccaggtcggtctgaatggttggactcgccacatcaactaggtcagctattgaagtgccaactaaaggtcgtattgaagcaatcggtcctatggcaagtcaagtgacagtcgtaggtatggcacttgccgcgcctccagaactcggtcaagctacctcataactcggaagtcgactgctctaaagcgaagttgtcaaacgaacagctatgccttcgagtaaagcaaggtgcgcaatagtaaccttggtaacttcggaactgcgtcaagccgctaactccatcggtatggaagtcgctaaagtcggtcaaacggaagcggctatcgtcgcaactagtcgaatagttgtcgaagaggccagagcaaccatggttgccattgtcttcgtggtctatgcaagacgtccttgcgtcatggcctaagcatcttcttcactggttgctatagcggaagtcgttaccgaactggtcgccagtcgaatcgtttgccccatggtagtcatcaccaccatcgcggaaaccaacggtccgaactcacggtaggtagtccacgtatgtagcccacctttcgaaggaatcgtggtcgccggtctcctagaaacggtatatgtcttgcgtcacgcttatggaccggtcatcctggccagtagccgacttgtggtcgctatagctttcgctagtccctgccttaacgtgcagcatggtatggctattgtcgtcccggctacaaccactatcgtggtcttgaaactggtcgtcgctacaaccatcctagcattggcaccagcggtcgttgaagccgaaggtagtctctaactggttttcgaagctagtcaaacagtagcgccatatggcctagcctgaaccttagaaaaaggagtcgaaggtcctaaacccgctggtcgcgaacgaacaaaaacggtcgttaaaggccgtccggaagcggaaggtcgtcgccccaggtgaacaagtcctaaagaaacaaaaagtctctgtagtctatttaaaacccaacgcaaacgcgaacgcagaatcgtctgaacccacgtccatcattacggattatataaggtttctgtttcgttaactaggtagttattgatgtcatccgcactacaagctaacaggaggtaacagatagagcatgagtggtagtagggatgaaacaggaagtactaattacatacagggactcctggttgggtgaccccgggacacgtacgtgtcctaataaacaggaggcgggtggtttcctatctactacggacagggattttccccgagtagcgaaggatatgaaacttctagttatagacatataagacgtagtccaggaagtcggctgagtccatgaggtcagttttggaggagaagtagttgtcacgatccttagttaagataacaaagtccgagtagttatcacgacttgctgactgcgtccactatgtttccggggtgggcatggggacttgcacacggataactccatccggattattaagacgaggtggggtgtgctgggctcccaggaacttcatcggagtgacgtagaaccttcagtttgagtccacgtaggacaccagcgctattggtgccgacgacgagtacaaacatccggaaacttagcatattaggtaagagtttctgtatgctcggacgtcgtcgttagagcagacccagaaggtgtccatggacacacatcatacaagacaacttggtcaacttttacggggctggggccaattatcccgggagtcctcacgatcagaaaccgactggtttgtcacactctggttagaggaggggtcaccacgatgggtgagggggtggtgggtgtttatacaagagtctgggactccaaagacgatattacgacgagacgacttatccacgtactttgtttcccaaacccacgcaactccacctttagtccacacaaactagtacgagacacccggattcaaggtcgtgacc

SEQ ID NO: 115 - DNA, 2029 bp, Artificial Sequence
  transcript variant
ggaccgaagcatactgcaagacttgtaggcccatgaattacccgcttaggcaatgggtagacctttccttgccgcgtggaacaaaccgccatgagtgttttacgtttacggtcggcgaccggagtcacagcgcgaccaacggggccaggcaaaggcccataggcttttccatcggcacgcgaccgattccatcaagtgttaggtgcaatccccattcgggacggacacgcgagagcgttagtcggcgcgtgcgcgggactatttagcgaaggtcgccgatcgtttgcccgtaaaactaactggcaaaagcctaagtgctgtttcgggtgcaatggtataacttcccacatttagccgaatagcgccaacagcgttattatttggaaccaagcagtgggcgatgtcagcgacaattccactttggtagaggtcgttcttttgtagaaaacaatctaacataactatgacactttcggtaaattcaccacctttaccagggtcgtaagtggtcaagccacgccgaccacttcataagcattggtggaaatcgcatcgacacaataaaagtacaccaaccagcagaaaacaggtacatatacagtttaacgacctggatctaagatgactacagtagcatagccatagaacatggcactgaaatatcgatgggcgtaaaagtgaacaacgcagacgatggattacgacgccaagccactataaatgctaattgagtcgaagaaggtactcctttttggaacacagatattgcagaagcgggaatgaggttgatattacatcaagtatcaacagacgacctcagaagggtggtcttttaaaatgacaacgtacattaagatgcagacaaacactactatgctggagtgttgtattaattcactctagagtaatggatcacggtgccagaaactaaggtggtgtaggactagatgcaagtaacaacggtcgtactaaaatcagctacgcgatcgccgacttagaaggctgagatggagaaacttgtctactggcagacctcactatcttttaggaaggtcacgaagcggctggagtgatggctagtctcagccactgtcaacgggaagcgcgacgtttatggtcaatataaactagcagtttaatccgtatggcgatcttagcggatgttacaggatggagaagatgacaaagtagaagctagacaactatatcaaatcgttgtgtggtcttaaaccgacacagtagcattcatcgttggatgtggaaggtcacagcctcgttggaggagatactacggtcccgcttttcgtgggtgacaaaggtcgcaaaggtttccttagggaggtcgtttcccggatctttatctacatctcctgggtgaaggggatgatctttctctacatgtcctgggtggaggggagtttccttgtatgggtggaacccaacccgccggtgagggtgagttacggtcggcggtcatatgtgggtatgacgggtatgacgtcataaatagtcgttgtcaaaatgggaggtggaagtccttactgtagtcacccgtgaaggtggagaactggcaggacatctctaggtcacctaaacgtgcgaagtgtgcgaaattaccaccgtaaattcgtcctactgaaagtgcttacgcatcttgagagagattgcagagagccaggtcaaatacattgagaaatctgtatatgtactttggtaacgctctaaggtaggtacacgttagtgatataaaaagaaggcgacgacgaacttaaattgttagagcagtttatgggtggtaggttacatctatttacttcaaaacgcggtgccctagcccacaagcattgctttgtaaaattgttgaaggtaacttgtaaaagccgaacatgaacgatggatagtagaccgggaagaccaacgttttttcactactccgaaagaacacactgaagggaacggtgtaggttcggtgagtccgggactaggtgtccatgtcggagacctcagtggtgacgtcctcgtagtatag

SEQ ID NO: 116 - DNA, 552 bp, Artificial Sequence
  transcript variant
gcatactgcaagacttgtaggcccatgaattacccgcttaggcaatgggtagacctttccttgccgcgtggaacaaaccgccatgagtgttttacgtttacggtcggcgaccggagtcacagcgcgaccaacggggccaggcaaaggcccataggcttttccatcggcacgcgaccgattccatcaagtatagccacggtcgtaacttcgacggcggcaatagtttatggcgctaacacctttccatcgctgagtccaaacgtatgacgtgaggtgttaggtgcaatccccattcgggacggacacgcgagtaaaggtctaacatgtttcaactttccagttagtcgccgtcctatattggcaagaccggatggccgtcaaccagttccattctgactatttgccacattgattaaagaagtaggagcgttagtcggcgcgtgcgcgggactatttagcgaaggtcgccgtatcgcgggtggcggcgtttccgccataacaacaagcgtttaaggtcagagtccgcgacgaatgaaacgccgtgcaagcggc

SEQ ID NO: 117 - DNA, 533 bp, Artificial Sequence
  transcript variant
ggcccatgaattacccgcttaggcaatgggtagacctttccttgccgcgtggaacaaaccgccatgagtgttttacgtttacggtcggcgaccggagtcacagcgcgaccaacggggccagggaggaagccttttagccatcgctatgccgccgctcaaacgcgccgggtgcaaaagcccagagcaaaggcccataggcttttccatcggcacgcgaccgattccatcaagtgttaggtgcaatccccattcgggacggacacgcgagagcgttagtcggcgcgtgcgcgggactatttagcgaaggtcgccgatcgtttgcccgtaaaactaactggcaaaagcctaagtgctgtttcgggtgcaatggtataacttcccacatttagccgaatagcgccaacagcgttattatttggaaccaagcagtgggcgatgtcagcgacaattccactttggtagaggtcgttcttttgtagaaaacaatctaacataactatgacactttcggtaaattcaccacctttaccagg

SEQ ID NO: 118 - DNA, 2085 bp, Artificial Sequence
  transcript variant
gcatactgcaagacttgtaggcccatgaattacccgcttaggcaatgggtagacctttccttgccgcgtggaacaaaccgccatgagtgttttacgtttacggtcggcgaccggagtcacagcgcgaccaacggggccaggcaaaggcccataggcttttccatcggcacgcgaccgattccatcaagtgttaggtgcaatccccattcgggacggacacgcgagagcgttagtcggcgcgtgcgcgggactatttagcgaaggtcgccgatcgtttgcccgtaaaactaactggcaaaagcctaagtgctgtttcgggtgcaatggtataacttcccacatttagccgaatagcgccaacagcgttattatttggaaccaagcagtgggcgatgtcagcgacaattccactttggtagaggtcgttcttttgtagaaaacaatctaacataactatgacactttcggtaaattcaccacctttaccagggtcgtaagtggtcaagccacgccgaccacttcataagcattggtggaaatcgcatcgacacaataaaagtacaccaaccagcagaaaacaggtacatatacagtttaacgacctggatctaagatgactacagtagcatagccatagaacatggcactgaaatatcgatgggcgtaaaagtgaacaacgcagacgatggattacgacgccaagccactataaatgctaattgagtcgaagaaggtactcctttttggaacacagatattgcagaagcgggaatgaggttgatattacatcaagtatcaacagacgacctcagaagggtggtcttttaaaatgacaacgtacattaagatgcagacaaacactactatgctggatgtgaaaatgtcatatgtgcggcaaaaatagacgacatttaagaacctagcattataggatggagtgttgtattaattcactctagagtaatggatcacggtgccagaaactaaggtggtgtaggactagatgcaagtaacaacggtcgtactaaaatcagctacgcgatcgccgacttagaaggctgagatggagaaacttgtctactggcagacctcactatcttttaggaaggtcacgaagcggctggagtgatggctagtctcagccactgtcaacgggaagcgcgacgtttatggtcaatataaactagcagtttaatccgtatggcgatcttagcggatgttacaggatggagaagatgacaaagtagaagctagacaactatatcaaatcgttgtgtggtcttaaaccgacacagtagcattcatcgttggatgtggaaggtcacagcctcgttggaggagatactacggtcccgcttttcgtgggtgacaaaggtcgcaaaggtttccttagggaggtcgtttcccggatctttatctacatctcctgggtgaaggggatgatctttctctacatgtcctgggtggaggggagtttccttgtatgggtggaacccaacccgccggtgagggtgagttacggtcggcggtcatatgtgggtatgacgggtatgacgtcataaatagtcgttgtcaaaatgggaggtggaagtccttactgtagtcacccgtgaaggtggagaactggcaggacatctctaggtcacctaaacgtgcgaagtgtgcgaaattaccaccgtaaattcgtcctactgaaagtgcttacgcatcttgagagagattgcagagagccaggtcaaatacattgagaaatctgtatatgtactttggtaacgctctaaggtaggtacacgttagtgatataaaaagaaggcgacgacgaacttaaattgttagagcagtttatgggtggtaggttacatctatttacttcaaaacgcggtgccctagcccacaagcattgctttgtaaaattgttgaaggtaacttgtaaaagccgaacatgaacgatggatagtagaccgggaagaccaacgttttttcactactccgaaagaacacactgaagggaacggtgtaggttcggtgagtccgggactaggtgtccatgtcggagacctcagtggtgacgtcctcgtagtatag

SEQ ID NO: 119 - DNA, 885 bp, Artificial Sequence
  transcript variant
gtatatgtactttggtaacgctctaaggtaggtacacgttagtgatataaaaagaaggcgacgacgaacttaaattgttagagcagtttatgggtggtaggttacatctatttacttcaaaacgcggtgccctagcccacaagcattgctttgtaaaattgttgaaggtaacttgtaaaagccgaacatgaacgatggatagtagaccgggaagaccaacgttttttcactactccgaaagaacacactgaagggaacggtgtaggttcggtgagtccgggactaggtgtccatgtcggagacctcagtggtgacgtcctcgtagtatagctgctcgcatgaccagctatatctggaacatcgctggtgggtcttatggtcgcttttgtgggaaccatcatagtcgcaagtctggccttcggtatggaactcgtcgtcccgactacaaccatagctagtctcggtctcggctttgttgcaatgcccttcgttactacttcaacggtcgtggtgccggtcaaaccgctcgctaaagcaagcgaagaaacagctaaacttagttgtgtcgaaacatcctaagtggtcgggttgctcgtggagcatgcagctagcccagaacctttagcttgtgtggtcttcgtctcggtagtcagaaccaggtcggtctgaatggttggactcgccacatcaactaggtcagctattgaagtgccaactaaaggtcgtattgaagcaatcggtcctatggcaagtcaagtgacagtcgtaggtatggcacttgccgcgcctccagaactcggtcaagctacctcataactcggaagtcgactgctctaaagcgaagttgtcaaacgaacagctatgccttcgagtaaagcaaggtgc

SEQ ID NO: 120 - DNA, 2474 bp, Artificial Sequence
  transcript variant
gcccatgaattacccgcttaggcaatgggtagacctttccttgccgcgtggaacaaaccgccatgagtgttttacgtttacggtcggcgaccggagtcacagcgcgaccaacggggccaggcaaaggcccataggcttttccatcggcacgcgaccgattccatcaagtgttaggtgcaatccccattcgggacggacacgcgagagcgttagtcggcgcgtgcgcgggactatttagcgaaggtcgccgatcgtttgcccgtaaaactaactggcaaaagcctaagtgctgtttcgggtgcaatggtataacttcccacatttagccgaatagcgccaacagcgttattatttggaaccaagcagtgggcgatgtcagcgacaattccactttggtagaggtcgttcttttgtagaaaacaatctaacataactatgacactttcggtaaattcaccacctttaccagggtcgtaagtggtcaagccacgccgaccacttcataagcattggtggaaatcgcatcgacacaataaaagtacaccaaccagcagaaaacaggtacatatacagtttaacgacctggatctaagatgactacagtagcatagccatagaacatggcactgaaatatcgatgggcgtaaaagtgaacaacgcagacgatggattacgacgccaagccactataaatgctaattgagtcgaagaaggtactcctttttggaacacagatattgcagaagcgggaatgaggttgatattacatcaagtatcaacagacgacctcagaagggtggtcttttaaaatgacaacgtacattaagatgcagacaaacactactatgctggagtgttgtattaattcactctagagtaatggatcacggtgccagaaactaaggtggtgtaggactagatgcaagtaacaacggtcgtactaaaatcagctacgcgatcgccgacttagaaggctgagatggagaaacttgtctactggcagacctcactatcttttaggaaggtcacgaagcggctggagtgatggctagtctcagccactgtcaacgggaagcgcgacgtttatggtcaatataaactagcagtttaatccgtatggcgatcttagcggatgttacaggatggagaagatgacaaagtagaagctagacaactatatcaaatcgttgtgtggtcttaaaccgacacagtagcattcatcgttggatgtggaaggtcacagcctcgttggaggagatactacggtcccgcttttcgtgggtgacaaaggtcgcaaaggtttccttagggaggtcgtttcccggatctttatctacatctcctgggtgaaggggatgatctttctctacatagattgcagagagccaggtcaaatacattgagaaatctgtatatgtactttggtaacgctctaaggtaggtacacgttagtgatataaaaagaaggcgacgacgaacttaaattgttagagcagtttatgggtggtaggttacatctatttacttcaaaacgcggtgccctagcccacaagcattgctttgtaaaattgttgaaggtaacttgtaaaagccgaacatgaacgatggatagtagaccgggaagaccaacgttttttcactactccgaaagaacacactgaagggaacggtgtaggttcggtgagtccgggactaggtgtccatgtcggagacctcagtggtgacgtcctcgtagtataggtccacgctctaagtcgcttgcccaattgtggctaccgcattgctcagaacttcgggtactggccaaccttcaagaagcctagtcttggtgcgtcaccccagtcacgtagcatacccgtcatcatctatggtcgtaggtccaacaatcgtggcgccattgggtaccacttcatcagagctgctcgcatgaccagctatatctggaacatcgctggtgggtcttatggtcgcttttgtgggaaccatcatagtcgcaagtctggccttcggtatggaactcgtcgtcccgactacaaccatagctagtctcggtctcggctttgttgcaatgcccttcgttactacttcaacggtcgtggtgccggtcaaaccgctcgctaaagcaagcgaagaaacagctaaacttagttgtgtcgaaacatcctaagtggtcgggttgctcgtggagcatgcagctagcccagaacctttagcttgtgtggtcttcgtctcggtagtcagaaccaggtcggtctgaatggttggactcgccacatcaactaggtcagctattgaagtgccaactaaaggtcgtattgaagcaatcggtcctatggcaagtcaagtgacagtcgtaggtatggcacttgccgcgcctccagaactcggtcaagctacctcataactcggaagtcgactgctctaaagcgaagttgtcaaacgaacagctatgccttcgagtaaagcaaggtgcg

SEQ ID NO: 121 - DNA, 546 bp, Artificial Sequence
  transcript variant
gcatactgcaagacttgtaggcccatgaattacccgcttaggcaatgggtagacctttccttgccgcgtggaacaaaccgccatgagtgttttacgtttacggtcggcgaccggagtcacagcgcgaccaacgggcaaaggcccataggcttttccatcggcacgcgaccgattccatcaagtatagccacggtcgtaacttcgacggcggcaatagtttatggcgctaacacctttccatcgctgagtccaaacgtatgacgtgaggtgttaggtgcaatccccattcgggacggacacgcgagtaaaggtctaacatgtttcaactttccagttagtcgccgtcctatattggcaagaccggatggccgtcaaccagttccattctgactatttgccacattgattaaagaagtaggagcgttagtcggcgcgtgcgcgggactatttagcgaaggtcgccgtatcgcgggtggcggcgtttccgccataacaacaagcgtttaaggtcagagtccgcgacgaatgaaacgccgtgcaagcggc

SEQ ID NO: 122 - DNA, 229 bp, Artificial Sequence
  transcript variant
gtaccaaagccgcttgcacggcgtttcattcgtcgcggactctgaccttaaacgcttgttgttatggcggaaacgccgccacccgcgatacggcgaccttcgctaaatagtcccgcgcacgcgccgactaacgctcctacttctttaatcaatgtggcaaatagtcagaatggaactggttgacggccatccggtcttgccaatataggacggcgactaactggaaagt

SEQ ID NO: 123 - DNA, 1435 bp, Artificial Sequence
  transcript variant
ggcaagacgaatctgcgtcaacgctaaaggccgtcaaaaagcaagagggcgtcgcgcctgggaaaaaggtagtcaagaaaccatcaagcttaaatgtcgggaaattgggtttgcgccgccttcaggggcagcgatgggggcgacaattgtggaccgtatggactccattatgctgggactcctcgggtcaaccgctctaaagcgaagttgttggacaaacagttatgcgtaactgtaaagcaaggtgcccaaagtagactgagcgacagtcgaaaccagccccaatgaacaagacgccattgcaaaacgtctatacgctacggtcaaagacgcttccacaccacatgttgtgctcgccatttcaactagtgcagttgctaaagtgccaactaaggttcgtcttgaagcaatcggtagtatctgcagtcaagtcgtagtcgtaggtatggcacttgtcgtgcgtctaggacgcgttgaagctatcttattgcccgaaggagccgaaagtctgggacacgtcgtgggacgtatcgttaggactatgggactagtcgtcttcggtcttacaaatgttgcaatgccctgtgagctacttatgaaacatgaatggtcggtcttgtggtcgcttttgtcgaaatcaccgaagtgcgtataattgatgaacgagtcgaagtcgaagttgttcaacaagagagttaggtagtgccgcttgaaaaagtaatagtgcaaataagaaaaagaagcgaaacggcattcgtttaacaaaacgtcacatatttaggtatagtagattgcgttcacaaagaaatttaaatttaatttaccatttcgtcattgtatatgcggtaaacgtaaatttacacatatgacacgaactttgagttttattagcctgcctaattgttggtaacaatgtaatggaaattggcgatgactatggggaaagagcaatcaactcaccataaatttgtgaacgcagttaagtaattggcatcgcgcgcctaatcgtttacattcgcatggaacaagaagaaagagacctattcgtgggagtcaatggctatgtggaaaaacatgaactgccaaattcggctaaccaaccagaaatggtcatggaaaattcttgcgtcaaagttcgcggtgacgtttacgaagaagctaaacttgtgcttgtttagaaagttaggtgcgtcctggttttagtaaatttagaaaaccattttgttgtttgcgacagttaaataaaacttaacgacaaagaagtgacttgcgtcgtagattaactggaaattaaagtggtatctaaaatggggtttgccgatgcggtcttcaaagtctaaaattcttgaagtttgcgtttggtcgcaaaaattatggatttagtcgattattgcctactaagcagcagtttagaagtttttaagatagttacgct

SEQ ID NO: 124 - DNA, 574 bp, Artificial Sequence
  transcript variant
ggggcagcgatgggggcgacaattgtggaccgtatggactccattatgctgggactcctcgggtcaaccgctctaaagcgaagttgttggacaaacagttatgcgtaactgtaaagcaaggtgcccaaagtagactgagcgacagtcgaaaccagccccaatgaacaagacgccattgcaaaacgtctatacgctacggtcaaagacgcttccacaccacatggactatgggactagtcgtcttcggtcttacaaatgttgcaatgccctgtgagctacttatgaaacatgaatggtcggtcttgtggtcgcttttgtcgaaatcaccgaagtgcgtataattgatgaacgagtcgaagtcgaagttgttcaacaagagagttaggtagtgccgcttgaaaaagtaatagtgcaaataagaaaaagaagcgaaacggcattcgtttaacaaaacgtcacatatttaggtatagtagattgcgttcacaaagaaatttaaatttaatttaccatttcgtcattgtatatgcggtaaacgtaaatttacacatatgacacgaactttgagttttat

SEQ ID NO: 125 - DNA, 1969 bp, Artificial Sequence
  transcript variant
gtgggtttatatcgcgtatccatccaacttaactgaaacgcgaagcagtagacagtgttgatcgagatttgcgaagggaaacagtaaaagtccagggtgtcgttaattacgacaaaactaaagactgtatagttagaaggatcaattgggctgatttagaaatggtataagttaaagaaatggaaacttattcgacaaaaagaaaaactcatgatgtatagatggaaactgccataatgtcgattcgagttatatttttagattttggtaaaatatccaacatgtattaacgaaattttgaagtatagatcaaactattcttcaggtacagcatcaagcattcggtagcataagccaaacaagtctttgaagggttggacatagcgagttgtgtagaaagttacgaagacttcaacagaaaaagagtttaaaaggaccacgtatgccaaatcgacaacaatatagtcgttctattctgcgatatgtaagatagagacacatcggcaggtagcatagaacttgggtcaattattatttaagtgcggtaacaaacaaacttagggaatattattgtgctacagcaaatgccttgaaaagtcgagaaagactactatactcgtcaagttcgtaaagacttaacagtaattgtaatgcaaatacttagcgagattgattccttcccagtagtcatctttcctttagatattagaacagcaattttagattttgtacatagtggagaaaaggacgtcattttaatggatgaaccagacgttaacgtcatttacttggtcgttgatttcgaagactcagtcatcaaaattgtagcttcgctagctaatgtgcttaaaatcatcatagtcaaagtgtacgtggtcgtggtaataaacaaccttcattactgtacaaaagtgccagtttgttacattatcgaacgctgtatagaggtatcatttcacctatttgacaactaggtgataaaccttcggtcgctagacgttgttgttattgaaaaaatggaagataatctatacttaatccaaaacaacccagaccaagctcgtatataaatggaagtcgtcaaaattggtttcgttcaaataagttgggactgatgaatcagttttctgaacttcaccgctattagcgtcctagttgtctacataattagtatcattattgtagtagtttaaatcgctaacaaccaaaaaatccttgacatgggtaacgacgttattggggaaccaatgctcagtgttggtgaaagaatcgttaggtcgaactattggtacgttctaataaaagacgacatagaaattcgttacataatcaacgtcactactaagggcgtattgcaaattagttcataaattattaacagtttgcacctaatagttctagtccttaaaaaggtagaagacgtaggtaatgtcagttgcctcaatgtagtcaggtaaaaagtatatgtgctgatggcaaacttcatctttgtgagagttgagcatgtataacaacatcactcagtataaccgcttggttacacaattagtatcatgcctatagaacgccttatcattcaggtcgtcgtgatagtgaaggggatcaaagtcaaaatctactttgtcataactctttacggtatcccaatgcttggtataagtgcttaagaaattgtttaaacagaaactcaagtataagcgaaaacaagttacctggaaaaagaagaagtgcgtataattgatgaacgagtcgaagtcgaagttgttcaacaagagagttaggtagtgccgcttgaaaaagtaatagtgcaaataagaaagtaagactgtatcggagacgactttttaatagtagtaattctcggtacaactaaaccagtaatttcagacactgaaatagaggacttcgttaggtacgaagcaagttaactaaatgacaattaaattgagggtaaatatcacaaagaaat

SEQ ID NO: 126 - DNA, 1537 bp, Artificial Sequence
  transcript variant
gcttaaatgtcgggaaattgggtttgcgccgccttcaggggcagcgatgggggcgacaattgtggaccgtatggactccattatgctgggactcctcgggtcaaccgctctaaagcgaagttgttggacaaacagttatgcgtaactgtaaagcaaggtgcccaaagtagactgagcgacagtcgaaaccagccccaatgaacaagacgccattgcaaaacgtctatacgctacggtcaaagacgcttccacaccacatgctctcatgtagcctaccttacgaagaaatcgcacaagtcggtcgcccagcggtggcatatgtcttgcctaacgtttctagaccgatcagcctcacgagtagcctgcttgtggtgtttatagtttacgctagtccaatctgtatcgtgccgcttggtatggctattgtcggcctggatgcaattgtgctcgccatttcaactagtgcagttgctaaagtgccaactaaggttcgtcttgaagcaatcggtagtatctgcagtcaagtcgtagtcgtaggtatggcacttgtcgtgcgtctaggacgcgttgaagctatcttattgcccgaaggagccgaaagtctgggacacgtcgtgggacgtatcgttaggactatgggactagtcgtcttcggtcttacaaatgttgcaatgccctgtgagctacttatgaaacatgaatggtcggtcttgtggtcgcttttgtcgaaatcaccgaagtgcgtataattgatgaacgagtcgaagtcgaagttgttcaacaagagagttaggtagtgccgcttgaaaaagtaatagtgcaaataagaaaaagcgaaacggcattcgtttaacaaaacgtcacatatttaggtatagtagattgcgttcacaaagaaatttaaatttaatttaccatttcgtcattgtatatgcggtaaacgtaaatttacacatatgacacgaactttgagttttattagcctgcctaattgttggtaacaatgtaatggaaattggcgatgactatggggaaagagcaatcaactcaccataaatttgtgaacgcagttaagtaattggcatcgcgcgcctaatcgtttacattcgcatggaacaagaagaaagagacctattcgtgggagtcaatggctatgtggaaaaacatgaactgccaaattcggctaaccaaccagaaatggtcatggaaaattcttgcgtcaaagttcgcggtgacgtttacgaagaagctaaacttgtgcttgtttagaaagttaggtgcgtcctggttttagtaaatttagaaaaccattttgttgtttgcgacagttaaataaaacttaacgacaaagaagtgacttgcgtcgtagattaactggaaattaaagtggtatctaaaatggggtttgccgatgcggtcttcaaagtctaaaattcttgaagtttgcgtttggtcgcaaaaattatggatttagtcgattattgcctactaagcagcagtttagaagtttttaagatagttacgctagaagaccggg

SEQ ID NO: 127 - DNA, 1088 bp, Artificial Sequence
  transcript variant
gcgatgggggcgacaattgtggaccgtatggactccattatgctgggactcctcgggtcaaccgctctaaagcgaagttgttggacaaacagttatgcgtaactgtaaagcaaggtgcccaaagtagactgagcgacagtcgaaaccagccccaatgaacaagacgccattgcaaaacgtctatacgctacggtcaaagacgcttccacaccacatgctctcatgtagcctaccttacgaagaaatcgcacaagtcggtcgcccagcggtggcatatgtcttgcctaacgtttctagaccgatcagcctcacgagtagcctgcttgtggtgtttatagtttacgctagtccaatctgtatcgtgccgcttggtatggctattgtcggcctggatgcaattgtgctcgccatttcaactagtgcagttgctaaagtgccaactaaggttcgtcttgaagcaatcggtagtatctgcagtcaagtcgtagtcgtaggtatggcacttgtcgtgcgtctaggacgcgttgaagctatcttattgcccgaaggagccgaaagtctgggacacgtcgtgggacgtatcgttaggactatgggactagtcgtcttcggtcttacaaatgttgcaatgccctgtgagctacttatgaaacatgaatggtcggtcttgtggtcgcttttgtcgaaatcaccgaagtgcgtataattgatgaacgagtcgaagtcgaagttgttcaacaagagagttaggtagtgccgcttgaaaaagtaatagtgcaaataagaaaaagaagcgaaacggcattcgtttaacaaaacgtcacatatttaggtatagtagattgcgttcacaaagaaatttaaagtcttgtaattatggtggtcgatttattggtagtatatttggaaatagcatgcaattttggaatggacgaagaacctgacatctgagctattgtaagtttaatttaccatttcgtcattgtatatgcggtaaacgtaaatttacacatatgacacgaactttgagttttattagcctgcctaattgttggtaacaatgtaatggaaattggcgatgactatgg

SEQ ID NO: 128 - DNA, 545 bp, Artificial Sequence
  transcript variant
gaatattgtttcaatggtcgtggcgctggtcagactgctcgctaaagtcgtcgaagaaacagctagaccatctattctctgaacttcctaagtggtcgggttggtcgtggcgctcatagttagcccagaacgtccagtttatgtggtggtgatcttggttgccagactcagtatggtcaaaatagttgtgctcgccatttcaactagtgcagttgctaaagtgccaactaaggttcgtcttgaagcaatcggtagtatctgcagtcaagtcgtagtcgtaggtatggcacttgtcgtgcgtctaggacgcgttgaagctatcttattgcccgaaggagccgaaagtctgggacacgtcgtgggacgtatcgttaggactatgggactagtcgtcttcggtcttacaaatgttgcaatgccctgtgagctacttatgaaacatgaatggtcggtcttgtggtcgcttttgtcgaaatcaccgaagtgcgtataattgatgaacgagtcgaagtcgaagttgttcaacaagagagttaggtagtgcc

SEQ ID NO: 129 - DNA, 574 bp, Artificial Sequence
  transcript variant
gcgatgggggcgacaattgtggaccgtatggactccattatgctgggactcctcgggtcaaccgctctaaagcgaagttgttggacaaacagttatgcgtaactgtaaagcaaggtgcccaagtagactcttactaatttgggaacgacggaaagtcgctaccttcatcggtatggctttcgctaaagtcggtcaaatggaagaaggtagtcgaagtactgttgaaagagtagactgagcgacagtcgaaaccagccccaatgaacaagacgccattgcaaaacgtctatacgctacggtcaaagacgcttccacaccacatgctctcatgtagcctaccttacgaagaaatcgcacaagtcggtcgcccagcggtggcatatgtcttgcctaacgtttctagaccgatcagcctcacgagtagcctgcttgtggtgtttatagtttacgctagtccaatctgtatcgtgccgcttggtatggctattgtcggcctggatgcaattgtgctcgccatttcaactagtgcagttgctaaagtgccaactaaggttcgtcttgaagcaatcggtag

SEQ ID NO: 130 - DNA, 377 bp, Artificial Sequence
  transcript variant
gcctatgcctcgtatcatctatggtcgtaggtaaagcaatagcggaaacattggatgtgacttcatcaggactgctcgtatagtgagctacttatgaaacatgaatggtcggtcttgtggtcgcttttgtcgaaatcaccgaagtgcgtataattgatgaacgagtcgaagtcgaagttgttcaacaagagagttaggtagtgccgcttgaaaaagtaatagtgcaaataagaaaaagaagcgaaacggcattcgtttaacaaaacgtcacatatttaggtatagtagattgcgttcacaaagaaatttaaatttaatttaccatttcgtcattgtatatgcggtaaacgtaaatttacacatatgacacgaacttt

SEQ ID NO: 131 - DNA, 485 bp, Artificial Sequence
  transcript variant
gggcgacaattgtggaccgtatggactccattatgctgggactcctcgggtcaaccgctctaaagcgaagttgttggacaaacagttatgcgtaactgtaaagcaaggtgcccaaagtagactgagcgacagtcgaaaccagccccaatgaacaagacgccattgcaaaacgtctatacgctacggtcaaagacgcttccacaccacatgctctcatgtagcctaccttacgaagaaatcgcacaagtcggtcgcccagcggtggcatatgtcttgcctaacgtttctagaccgatcagcctcacgagtagcctgcttgtggtgtttatagtttacgctagtccaatctgtatcgtgccgcttggtatggctattgtcggcctggatgcaagcactaacgtggtcatcagactggtctgcgctataatctacgcaatagaggcaccagcggtcgttgaagccgaagacgctatttcggtggcttg

SEQ ID NO: 132 - DNA, 1163 bp, Artificial Sequence
  transcript variant
gtgctcgccatttcaactagtgcagttgctaaagtgccaactaaggttcgtcttgaagcaatcggtagtatctgcagtcaagtcgtagtcgtaggtatggcacttgtcgtgcgtctaggacgcgttgaagctatcttattgcccgaaggagccgaaagtctgggacacgtcgtgggacgtatcgttaggactatgggactagtcgtcttcggtcttacaaatgttgcaatgccctgtgagctacttatgaaacatgaatggtcggtcttgtggtcgcttttgtcgaaatcaccgaagtgcgtataattgatgaacgagtcgaagtcgaagttgttcaacaagagagttaggtagtgccgcttgaaaaagtaatagtgcaaataagaaagtaagactgtatcggagacgactttttaatagtagtaattctcggtacaactaaaccagtaatttcagacactgaaatagaggacttcgttaggtacgaagcaagttaactaaatgacaattaaattgagggtaaatatcacaaagaaatcatggaagatttcgaccgaatacaggaaaatttagattaaaggtttgtcgtcgttgaaataagaagaagcgaaacggcattcgtttaacaaaacgtcacatatttaggtatagtagattgcgttcacaaagaaatttaaatttaatttaccatttcgtcattgtatatgcggtaaacgtaaatttacacatatgacacgaactttgagttttattagcctgcctaattgttggtaacaatgtaatggaaattggcgatgactatggggaaagagcaatcaactcaccataaatttgtgaacgcagttaagtaattggcatcgcgcgcctaatcgtttacattcgcatggaacaagaagaaagagacctattcgtgggagtcaatggctatgtggaaaaacatgaactgccaaattcggctaaccaaccagaaatggtcatggaaaattcttgcgtcaaagttcgcggtgacgtttacgaagaagctaaacttgtgcttgtttagaaagttaggtgcgtcctggttttagtaaatttagaaaaccattttgttgtttgcgacagttaaataaaacttaacgacaaagaagtgacttgcgtcgtagattaactggaaattaaagtgg

SEQ ID NO: 133 - DNA, 454 bp, Artificial Sequence
  transcript variant
ggtagttgttgaaaaagtaggaatatctagcctagatgtcgtttcaggcgaaggactctaaggtcttaaaatcgttgggtcaaccgctctaaagcgaagttgttggacaaacagttatgcgtaactgtaaagcaaggtgcccaaagtagactgagcgacagtcgaaaccagccccaatgaacaagacgccattgcaaaacgtctatacgctacggtcaaagacgcttccacaccacatggtatagtggacgccgttagcctcatgtgtctcactcaaagaccttgcgtcacggtcatcctctttgtcagcaacgtagaaatctccggtctgtcgataccttgcgtaaagctctcatgtagcctaccttacgaagaaatcgcacaagtcggtcgcccagcggtggcatatgtcttgcctaacgtttctagaccgatcagcctcacgagtagcctg

SEQ ID NO: 134 - DNA, 1528 bp, Artificial Sequence
  transcript variant
gcttaaatgtcgggaaattgggtttgcgccgccttcaggggcagcgatgggggcgacaattgtggaccgtatggactccattatgctgggactcctcgggtcaaccgctctaaagcgaagttgttggacaaacagttatgcgtaactgtaaagcaaggtgcccaaagtagactgagcgacagtcgaaaccagccccaatgaacaagacgccattgcaaaacgtctatacgctacggtcaaagacgcttccacaccacatgctctcatgtagcctaccttacgaagaaatcgcacaagtcggtcgcccagcggtggcatatgtcttgcctaacgtttctagaccgatcagcctcacgagtagcctgcttgtggtgtttatagtttacgctagtccaatctgtatcgtgccgcttggtatggctattgtcggcctggatgcaattgtgctcgccatttcaactagtgcagttgctaaagtgccaactaaggttcgtcttgaagcaatcggtagtatctgcagtcaagtcgtagtcgtaggtatggcacttgtcgtgcgtctaggacgcgttgaagctatcttattgcccgaaggagccgaaagtctgggacacgtcgtgggacgtatcgttaggactatgggactagtcgtcttcggtcttacaaatgttgcaatgccctgtgagctacttatgaaacatgaatggtcggtcttgtggtcgcttttgtcgaaatcaccgaagtgcgtataattgatgaacgagtcgaagtcgaagttgttcaacaagagagttaggtagtgccgcttgaaaaagtaatagtgcaaataagaaaaagaagcgaaacggcattcgtttaacaaaacgtcacatatttaggtatagtagattgcgttcacaaagaaatttaaatttaatttaccatttcgtcattgtatatgcggtaaacgtaaatttacacatatgacacgaactttgagttttattagcctgcctaattgttggtaacaatgtaatggaaattggcgatgactatggggaaagagcaatcaactcaccataaatttgtgaacgcagttaagtaattggcatcgcgcgcctaatcgtttacattcgcatggaacaagaagaaagagacctattcgtgggagtcaatggctatgtggaaaaacatgaactgccaaattcggctaaccaaccagaaatggtcatggaaaattcttgcgtcaaagttcgcggtgacgtttacgaagaagctaaacttgtgcttgtttagaaagttaggtgcgtcctggttttagtaaatttagaaaaccattttgttgtttgcgacagttaaataaaacttaacgacaaagaagtgacttgcgtcgtagattaactggaaattaaagtggtatctaaaatggggtttgccgatgcggtcttcaaagtctaaaattcttgaagtttgcgtttggtcgcaaaaattatggatttagtcgattattgcctactaagcagcagtttagaagtttttaagatagttacgc

SEQ ID NO: 135 - DNA, 1311 bp, Artificial Sequence
  transcript variant
gtgagctacttatgaaacatgaatggtcggtcttgtggtcgcttttgtcgaaatcaccggaaacattaaatcaaagaagtttatcaaccaattagtacagtggcatgttaagtaaaacagaaagaacgccaagtggcaacaaatgacgtaattatttaagcaaaaagcgtaaacgcttacaaaggctatttaaatatcagtaaatcgttggaaattgggtatgtgctgccttcatacgcaaaaatggatgcgacagaaacgagttgtatggcctccactacgctcgcctgccgcggaccctaaacgacagtcgtttgcccaactacggctacggcatcgctcagaacttcgggtcttggcccacctttctgacgcctagtcaacgtgcgtcgcctcagtcttggacaaaaagaagaaatatcaattgcaaaaataactataggtacttctttgaagaaaccaaacgtgagtttctaacacgactaaatccatttgatctttgagaaagtcgaagacgaatgaagtgcgtataattgatgaacgagtcgaagtcgaagttgttcaacaagagagttaggtagtgccgcttgaaaaagtaatagtgcaaataagaaaaagaagcgaaacggcattcgtttaacaaaacgtcacatatttaggtatagtagattgcgttcacaaagaaatttaaatttaatttaccatttcgtcattgtatatgcggtaaacgtaaatttacacatatgacacgaactttgagttttattagcctgcctaattgttggtaacaatgtaatggaaattggcgatgactatggggaaagagcaatcaactcaccataaatttgtgaacgcagttaagtaattggcatcgcgcgcctaatcgtttacattcgcatggaacaagaagaaagagacctattcgtgggagtcaatggctatgtggaaaaacatgaactgccaaattcggctaaccaaccagaaatggtcatggaaaattcttgcgtcaaagttcgcggtgacgtttacgaagaagctaaacttgtgcttgtttagaaagttaggtgcgtcctggttttagtaaatttagaaaaccattttgttgtttgcgacagttaaataaaacttaacgacaaagaagtgacttgcgtcgtagattaactggaaattaaagtggtatctaaaatggggtttgccgatgcggtcttcaaagtctaaaattcttgaagtttgcgtttggtcgcaaaaattatggatttagtcgattattgcctactaagcagcagtttagaagtttttaagatagttacg

SEQ ID NO: 136 - DNA, 459 bp, Artificial Sequence
  transcript variant
ggttcgtcttgaagcaatcggtagtatctgcagtcaagtcgtagtcgtaggtatggcacttgtcgtgcgtctaggacgcgttgaagctatcttattgcccgaaggagccgaaagtctgggacacgtcgtgggacgtatcgttaggactatgggactagtcgtcttcggtcttacaaatgttgcaatgccctgtgagctacttatgaaacatgaatggtcggtcttgtggtcgcttttgtcgaaatcaccggacaaaaagaagaaatatcaattgcaaaaataactataggtacttctttgaagaaaccaaacgtgagtttctaacacgactaaatccatttgatctttgagaaagtcgaagacgaatgaagtgcgtataattgatgaacgagtcgaagtcgaagttgttcaacaagagagttaggtagtgccgcttgaaaaagtaatagtgcaaataag

SEQ ID NO: 137 - DNA, 783 bp, Artificial Sequence
  transcript variant
ggggaaccaatgctcagtgttggtgaaagaatcgttaggtcgaactattggtacgttctaataaaagacgacatagaaattcgttacataatcaacgtcactactaagggcgtattgcaaattagttcataaattattaacagtttgcacctaatagttctagtccttaaaaaggtagaagacgtaggtaatgtcagttgcctcaatgtagtcaggtaaaaagtatatgtgctgatggcaaacttcatctttgtgagagttgagcatgtataacaacatcactcagtataaccgcttggttacacaattagtatcatgcctatagaacgccttatcattcaggtcgtcgtgatagtgaaggggatcaaagtcaaaatctactttgtcataactctttacggtatcccaatgcttggtataagtgcttaagaaattgtttaaacagaaactcaagtataagcgaaaacaagttacctggaaaaagaagaagtgcgtataattgatgaacgagtcgaagtcgaagttgttcaacaagagagttaggtagtgccgcttgaaaaagtaatagtgcaaataagaaaaagaagcgaaacggcattcgtttaacaaaacgtcacatatttaggtatagtagattgcgttcacaaagaaatttaaatttaatttaccatttcgtcattgtatatgcggtaaacgtaaatttacacatatgacacgaactttgagttttattagcctgcctaattgttggtaacaatgtaatggaaattggcgatgactatg

SEQ ID NO: 138 - DNA, 531 bp, Artificial Sequence
  transcript variant
gaatattgtttcaatggtcgtggcgctggtcagactgctcgctaaagtcgtcgaagaaacagctagaccatctattctctgaacttcctaagtggtcgggttggtcgtggcgctcatagttagcccagaacgtccagtttatgtggtggtgatcttggttgccagactcagtatggtcaaaatagttgtgctcgccatttcaactagtgcagttgctaaagtgccaactaaggttcgtcttgaagcaatcggtagtatctgcagtcaagtcgtagtcgtaggtatggcacttgtcgtgcgtctaggacgcgttgaagctatcttattgcccgaaggagccgaaagtctgggacacgtcgtgggacgtatcgttaggactatgggactagtcgtcttcggtcttacaaattgagctacttatgaaacatgaatggtcggtcttgtggtcgcttttgtcgaaatcaccgaagtgcgtataattgatgaacgagtcgaagtcgaagttgttcaacaagagagttaggtagtgcc

SEQ ID NO: 139 - DNA, 276 bp, Artificial Sequence
  transcript variant
gagatttctacgttgctgacaaagaggatgaccgtgacgcaaggtctttgagtgagacacatgaggctaacggcgtccactataccatgtggtgtggaagcgtctttgaccgtagcgtatagacgttttgcaatggcgtcttgttcattggggctggtttcgactgtcgctcagtctactctttcaacagtacttcgactaccttcttccatttgaccgactttagcgaaagccataccgatgaaggtagcgactttccgtcgttcccaaattagt

SEQ ID NO: 140 - DNA, 189 bp, Artificial Sequence
  transcript variant
gcagatactaccgattgcttcaagacgaaccttagttggcactttagcaactgcactagttgaaatggcgagcacaactattttgaccatactgagtctggcaaccaagatcaccaccacataaactggacgttctgggctaactatgagcgccacgaccaacccgaccacttaggaagttcagagaat

SEQ ID NO: 141 - DNA, 2462 bp, Artificial Sequence
  transcript variant
gagacgatgaaacttgagaaatcgcactggcttacatatacacgataaaagactttaatacaatataagaagtcgttattgaagacggagatgtatgttaccgcccaattttagagatacaaaatgagactgacatagcggttaactatattagagcacgcctaagcattgaaggtttagtcatcttcattagagtatactgtattgacggctgaatgcaaataaattgagacaaaaccgatttcttgaattagcacgaagtaagtataaaactagtagagtgacaccaagtatatagggggtttatatcgcgtggaatcgaacaacatatctatttaattagtttaataacaaattaagtgacttatcgcggaagagagaacaatagattggattaaaaagttgtagtaaaccacaacgaagttaggtagctggtaaggttatagatgcgttctgtcgttgtagtcccaatgaacatagtatggtttcgcatagtaactgacctaaaagaccgccacatagtgaaaatacttaaaacgcaagtttcataggattaagtggtagaggctatagaaaatgatatcataactataacgaatataacagcaaattaaaatgcactggaagtggaaaatttcagcaagagagtcgaagtcgtcatagattagcatggataatggcaattatagttaaaatagtcgtaaattagattatggtgcaccggggtgtaagtttcgaactcggtgaggcaatagtagtatagactaacaacaaggtagacattgcaatgtattgcgagaagaacttcacgaagatatagatacagtacagaatttctaggattaagtacagcagacgtatttacacctgttataggatacttgttcacttaatccctgttatgacaaagtagtctcatagaatttttagaacgagaagatttgaatggacgtaaaggaagaaggtcaaaatggagaacttaaaaggggaaatctagaacattgaacccaacattatacaatgatataagaacgaaaagacgaagacaataaggtccatgggatttacccaaatgaggacctaaatcaccgggaagaagtaagtaaacataacgatatagttttagattatcgagaagtcgaagaagaccgggataggtaacagataatcgacgtttgggaagacggtaacgtaagaaactgaggaggttaaagaactaagaatcaacaacaagaaactattgtccctattctacttaggtatctgctagtatgcgatatggaagttaaagaggaaacagtagtatgcactgtttgagaaaattaggatttaagaggtggagaagtcgttagtttggaagcatagatagttcaaatatccacagaaggctattaaaagatagaagagagtcgagagatcgattttaaagtctgagtcgaaatagtttggtgcaagattatccattcaattcttatcgaaaacttacaaggtcaacaagtagagatagcaatataactaaaagctatctattgaacataaatgcgcgactacagcttgcgggttaacacggtcgtcttcattatacgtttaatcgacgccggcttattcatgcagatatttaactcaatcttcgataggatagaggacgtagtagacttggatgtctgtcatccagacatgagacatatacttatatggataatggtagtgcagcaaagtcgtataatttaaacggtatgggacgaagctaacaacatagaggtggacaacgtatagcaggtaattgttaaacttgttctggaaataaagaaagaaatcttttggactatgggcgtggcattagtatcaagagtagtcttggtttgtattatattggcagtgagcttattcgtaatagacgtaatctgtcgcacttacgtttagccaaattaggtccgtgaaacagacacaaacctatatttatgtggccacggacaaacgaaaactataagctacttcgcattctgaggtcttgttgggctaataatagactgcaatcacgttgctggggtggtatccttaactaacaatatggtaagtacggtgatagtgacattcaaaatagggtggtaacttagcatggtctacttggtggcagaagtggaagtggtagttatattcagctttatggttttacactgtatatttcacttggcggtcgccacaataaagatttagaatccactggcagaaagtcagcgcatttttatagcagacaacttgcaaagggagaggttcatgcaacgtgttatggtggatcaagttatcttagtaagacataaacttgtatagacaataacagtggcggaaattaaggttaagataattgtaactatagttccgggagagaactatttaattccgacaactgttatagccaaaatagatgaaatagagcgtataaaacctattcttccaagcgt

SEQ ID NO: 142 - DNA, 2247 bp, Artificial Sequence
  transcript variant
gattggattaaaaagttgtagtaaaccacaacgaagttaggtagctggtaaggttatagatgcgttctgtcgttgtagtcccaatgaacatagtatggtttcgcatagtaactgacctaaaagaccgccacatagtgaaaatacttaaaacgcaagtttcataggattaagtggtagaggctatagaaaatgatatcataactataacgaatataacagcaaattaaaatgcactggaagtggaaaatttcagcaagagagtcgaagtcgtcatagattagcatggacgaaagaaaagtcgcaaagatcggaaatcaagacgcaaaacaaaacggagaagttcaaatcgaactcgtagaacatatcgctggaacatattaaactcttggtatcgctcagttacaaaaggagacacgtagacacgaaagaaactggaacaacagacatatttgtggataatggcaattatagttaaaatagtcgtaaattagattatggtgcaccggggtgtaagtttcgaactcggtgaggcaatagtagtatagactaacaacaaggtagacattgcaatgtattgcgagaagaacttcacgaagatatagatacagtacagaatttctaggattaagtacagcagacgtatttacacctgttataggatacttgttcacttaatccctgttatgacaaagtagtctcatagaatttttagaacgagaagatttgaatggacgtaaaggaagaaggtcaaaatggagaacttaaaaggggaaatctagaacattgaacccaacattatacaatgatataagaacgaaaagacgaagacaataaggtccatgggatttacccaaatgaggacctaaatcaccgggaagaagtaagtaaacataacgatatagttttagattatcgagaagtcgaagaagaccgggataggtaacagataatcgacgtttgggaagacggtaacgtaagaaactgaggaggttaaagaactaagaatcaacaacaagaaactattgtccctattctacttaggtatctgctagtatgcgatatggaagttaaagaggaaacagtagtatgcactgtttgagaaaattaggatttaagaggtggagaagtcgttagtttggaagcatagatagttcaaatatccacagaaggctattaaaagatagaagagagtcgagagatcgattttaaagtctgagtcgaaatagtttggtgcaagattatccattcaattcttatcgaaaacttacaaggtcaacaagtagagatagcaatataactaaaagctatctattgaacataaatgcgcgactacagcttgcgggttaacacggtcgtcttcattatacgtttaatcgacgccggcttattcatgcagatatttaactcaatcttcgataggatagaggacgtagtagacttggatgtctgtcatccagacatgagacatatacttatatggataatggtagtgcagcaaagtcgtataatttaaacggtatgggacgaagctaacaacatagaggtggacaacgtatagcaggtaattgttaaacttgttctggaaataaagaaagaaatcttttggactatgggcgtggcattagtatcaagagtagtcttggtttgtattatattggcagtgagcttattcgtaatagacgtaatctgtcgcacttacgtttagccaaattaggtccgtgaaacagacacaaacctatatttatgtggccacggacaaacgaaaactataagctacttcgcattctgaggtcttgttgggctaataatagactgcaatcacgttgctggggtggtatccttaactaacaatatggtaagtacggtgatagtgacattcaaaatagggtggtaacttagcatggtctacttggtggcagaagtggaagtggtagttatattcagctttatggttttacactgtatatttcacttggcggtcgccacaataaagatttagaatccactggcagaaagtcagcgcatttttatagcagacaacttgcaaagggagaggttcatgcaacgtgttatggtggatcaagttatcttagtaagacataaacttgtatagacaataacagtggcggaaattaaggttaagataattgtaactatagttccgggagagaactatttaattccgacaactgttatagccaaaatagatgaaatagagcgtataaaacctattcttccaagcgtaat

SEQ ID NO: 143 - DNA, 2498 bp, Artificial Sequence
  transcript variant
gatgaaacttgagaaatcgcactggcttacatatacacgataaaagactttaatacaatataagaagtcgttattgaagacggagatgtatgttaccgcccaattttagagatacaaaatgagactgacatagcggttaactatattagagcacgcctaagcattgaaggtttagtcatcttcattagagtatactgtattgacggctgaatgcaaataaattgagacaaaaccgatttcttgaattagcacgaagtaagtataaaactagtagagtgacaccaagtatatagggggtttatatcgcgtggaatcgaacaacatatctatttaattagtttaataacaaattaagtgacttatcgcggaagagagaacaatagattggattaaaaagttgtagtaaaccacaacgaagttaggtagctggtaaggttatagatgcgttctgtcgttgtagtcccaatgaacatagtatggtttcgcatagtaactgacctaaaagaccgccacatagtgaaaatacttaaaacgcaagtttcataggattaagtggtagaggctatagaaaatgatatcataactataacgaatataacagcaaattaaaatgcactggatgttagagcaaattatataaactttcacatgctaaccaacgtaatttgagaagaaatcatcaagaattaaactaaaggaatggtggataatggcaattatagttaaaatagtcgtaaattagattatggtgcaccggggtgtaagtttcgaactcggtgaggcaatagtagtatagactaacaacaaggtagacattgcaatgtattgcgagaagaacttcacgaagatatagatacagtacagaatttctaggattaagtacagcagacgtatttacacctgttataggatacttgttcacttaatccctgttatgacaaagtagtctcatagaatttttagaacgagaagatttgaatggacgtaaaggaagaaggtcaaaatggagaacttaaaaggggaaatctagaacattgaacccaacattatacaatgatataagaacgaaaagacgaagacaataaggtccatgggatttacccaaatgaggacctaaatcaccgggaagaagtaagtaaacataacgatatagttttagattatcgagaagtcgaagaagaccgggataggtaacagataatcgacgtttgggaagacggtaacgtaagaaactgaggaggttaaagaactaagaatcaacaacaagaaactattgtccctattctacttaggtatctgctagtatgcgatatggaagttaaagaggaaacagtagtatgcactgtttgagaaaattaggatttaagaggtggagaagtcgttagtttggaagcatagatagttcaaatatccacagaaggctattaaaagatagaagagagtcgagagatcgattttaaagtctgagtcgaaatagtttggtgcaagattatccattcaattcttatcgaaaacttacaaggtcaacaagtagagatagcaatataactaaaagctatctattgaacataaatgcgcgactacagcttgcgggttaacacggtcgtcttcattatacgtttaatcgacgccggcttattcatgcagatatttaactcaatcttcgataggatagaggacgtagtagacttggatgtctgtcatccagacatgagacatatacttatatggataatggtagtgcagcaaagtcgtataatttaaacggtatgggacgaagctaacaacatagaggtggacaacgtatagcaggtaattgttaaacttgttctggaaataaagaaagaaatcttttggactatgggcgtggcattagtatcaagagtagtcttggtttgtattatattggcagtgagcttattcgtaatagacgtaatctgtcgcacttacgtttagccaaattaggtccgtgaaacagacacaaacctatatttatgtggccacggacaaacgaaaactataagctacttcgcattctgaggtcttgttgggctaataatagactgcaatcacgttgctggggtggtatccttaactaacaatatggtaagtacggtgatagtgacattcaaaatagggtggtaacttagcatggtctacttggtggcagaagtggaagtggtagttatattcagctttatggttttacactgtatatttcacttggcggtcgccacaataaagatttagaatccactggcagaaagtcagcgcatttttatagcagacaacttgcaaagggagaggttcatgcaacgtgttatggtggatcaagttatcttagtaagacataaacttgtatagacaataacagtggcggaaattaaggttaagataattgtaactatagttccgggagagaactatttaattccgacaactgttatagccaaaatagatgaaatagagcgtataaaacctattcttccaagcgtaat

SEQ ID NO: 144 - DNA, 428 bp, Artificial Sequence
  transcript variant
ggctatagaaaatgatatcataactataacgaatataacagcaaattaaaatgcactggataataaaaattaaactaatatttgtagttagtggtgcagatttgaacgaacagtcaggcgaaatggaagtaatagatgattcatggacgataagtcattaagacatcgaagactgttttgttgttatggcagaaacagacaaaatatcaggctacaaaaatgtatcagagcattaacatgaaaaatcctaagagatcgacgaagttatcgactaaattgttgtaatccaagaggctgattgacgtttagaagtaagtggcaatttggtttaaaacaacgataataaaggttgcgaagaaatataaaaagtagtcacataacactgacattattaaatttagatagactttaccgctaaaactgtagtt

SEQ ID NO: 145 - DNA, 2462 bp, Artificial Sequence
  transcript variant
gtgagacgatgaaacttgagaaatcgcactggcttacatatacacgataaaagactttaatacaatataagaagtcgttattgaagacggagatgtatgttaccgcccaattttagagatacaaaatgagactgacatagcggttaactatattagagcacgcctaagcattgaaggtttagtcatcttcattagagtatactgtattgacggctgaatgcaaataaattgagacaaaaccgatttcttgaattagcacgaagtaagtataaaactagtagagtgacaccaagtatatagggggtttatatcgcgtggaatcgaacaacatatctatttaattagtttaataacaaattaagtgacttatcgcggaagagagaacaatagattggattaaaaagttgtagtaaaccacaacgaagttaggtagctggtaaggttatagatgcgttctgtcgttgtagtcccaatgaacatagtatggtttcgcatagtaactgacctaaaagaccgccacatagtgaaaatacttaaaacgcaagtttcataggattaagtggtagaggctatagaaaatgatatcataactataacgaatataacagcaaattaaaatgcactggaagtggaaaatttcagcaagagagtcgaagtcgtcatagattagcatggataatggcaattatagttaaaatagtcgtaaattagattatggtgcaccggggtgtaagtttcgaactcggtgaggcaatagtagtatagactaacaacaaggtagacattgcaatgtattgcgagaagaacttcacgaagatatagatacagtacagaatttctaggattaagtacagcagacgtatttacacctgttataggatacttgttcacttaatccctgttatgacaaagtagtctcatagaatttttagaacgagaagatttgaatggacgtaaaggaagaaggtcaaaatggagaacttaaaaggggaaatctagaacattgaacccaacattatacaatgatataagaacgaaaagacgaagacaataaggtccatgggatttacccaaatgaggacctaaatcaccgggaagaagtaagtaaacataacgatatagttttagattatcgagaagtcgaagaagaccgggataggtaacagataatcgacgtttgggaagacggtaacgtaagaaactgaggaggttaaagaactaagaatcaacaacaagaaactattgtccctattctacttaggtatctgctagtatgcgatatggaagttaaagaggaaacagtagtatgcactgtttgagaaaattaggatttaagaggtggagaagtcgttagtttggaagcatagatagttcaaatatccacagaaggctattaaaagatagaagagagtcgagagatcgattttaaagtctgagtcgaaatagtttggtgcaagattatccattcaattcttatcgaaaacttacaaggtcaacaagtagagatagcaatataactaaaagctatctattgaacataaatgcgcgactacagcttgcgggttaacacggtcgtcttcattatacgtttaatcgacgccggcttattcatgcagatatttaactcaatcttcgataggatagaggacgtagtagacttggatgtctgtcatccagacatgagacatatacttatatggataatggtagtgcagcaaagtcgtataatttaaacggtatgggacgaagctaacaacatagaggtggacaacgtatagcaggtaattgttaaacttgttctggaaataaagaaagaaatcttttggactatgggcgtggcattagtatcaagagtagtcttggtttgtattatattggcagtgagcttattcgtaatagacgtaatctgtcgcacttacgtttagccaaattaggtccgtgaaacagacacaaacctatatttatgtggccacggacaaacgaaaactataagctacttcgcattctgaggtcttgttgggctaataatagactgcaatcacgttgctggggtggtatccttaactaacaatatggtaagtacggtgatagtgacattcaaaatagggtggtaacttagcatggtctacttggtggcagaagtggaagtggtagttatattcagctttatggttttacactgtatatttcacttggcggtcgccacaataaagatttagaatccactggcagaaagtcagcgcatttttatagcagacaacttgcaaagggagaggttcatgcaacgtgttatggtggatcaagttatcttagtaagacataaacttgtatagacaataacagtggcggaaattaaggttaagataattgtaactatagttccgggagagaactatttaattccgacaactgttatagccaaaatagatgaaatagagcgtataaaacctattcttccaagc

SEQ ID NO: 146 - DNA, 949 bp, Artificial Sequence
  transcript variant
gtgccaaattagcgaacaatttgagaagagcagtgagacgatgaaacttgagaaatcgcactggcttacatatacacgataaaagactttaatacaatataagaagtcgttattgaagacggagatgtatgttaccgcccaattttagagatacaaaatgagactgacatagcggttaactatattagagcacgcctaagcattgaaggtttagtcatcttcattagagtatactgtattgacggctgaatgcaaataaattgagacaaaaccgatttcttgaattagcacgaagtaagtataaaactagtagagtgacaccaagtatatagggggtttatatcgcgtggaatcgaacaacatatctatttaattagtttaataacaaattaagtgacttatcgcggaagagagaacaatagattggattaaaaagttgtagtaaaccacaacgaagttaggtagctggtaaggttatagatgcgttctgtcgttgtagtcccaatgaacatagtatggtttcgcatagtaactgacctaaaagaccgccacatagtgaaaatacttaaaacgcaagtttcataggattaagtggtagaggctatagaaaatgatatcataactataacgaatataacagcaaattaaaatgcactggataataaaaattaaactaatatttgtagttagtggtgcagatttgaacgaacagtcaggcgaaatggaagtaatagatgattcatggacgataagtcattaagacatcgaagactgttttggatgtagacatatttgtagaacattaaagaaagatatgagttctttatttcaaaaacatagatggttggctggttagcaacgtcaaagcccacagtatctaatgttgttatggcagaaacagacaaaatatcaggctacaaaaatgtatcagagcattaacatgaaaaat

SEQ ID NO: 147 - DNA, 2326 bp, Artificial Sequence
  transcript variant
gcactggcttacatatacacgataaaagactttaatacaatataagaagtcgttattgaagacggagatgtatgttaccgcccaattttagagatacaaaatgagactgacatagcggttaactatattagagcacgcctaagcattgaaggtttagtcatcttcattagagtatactgtattgacggctgaatgcaaataaattgagacaaaaccgatttcttgaattagcacgaagtaagtataaaactagtagagtgacaccaagtatatagggggtttatatcgcgtggataataaaaattaaactaatatttgtagttagtggtgcagatttgaacgaacagtcaggcgaaatggaagtaatagatgattcatggacgataagtcattaagacatcgaagactgttttggaagtggaaaatttcagcaagagagtcgaagtcgtcatagattagcatggatttcgaagaacgcgaagaactaaacgaacaagttatgaacgaaattagagtcctaataacctgtttagtgaattgaccagtagtcatataacaaaaacaagaaggttaggcaaagctataagcaaatagcattgaaatagaaatggacgagaagaaggctttaaaatggtagtcgtatgcgaacgctaaggaagagaaattctagtagaactcgtagttacatacttggacgaaagaaaagtcgcaaagatcggaaatcaagacgcaaaacaaaacggagaagttcaaatcgaactcgtagaacatatcgctggaacatattaaactcttggtatcgctcagttacaaaaggagacacgtagacacgaaagaaactggaacaacagacatatttgtggatgttagagcaaattatataaactttcacatgctaaccaacgtaatttgagaagaaatcatcaagaattaaactaaaggaatggtggataatggcaattatagttaaaatagtcgtaaattagattatggtgcaccggggtgtaagtttcgaactcggtgaggcaatagtagtatagactaacaacaaggtagacattgcaatgtattgcgagaagaacttcacgaagatatagatacagtacagaatttctaggattaagtacagcagacgtatttacacctgttataggatacttgttcacttaatccctgttatgacaaagtagtctcatagaatttttagaacgagaagatttgaatggacgtaaaggaagaaggtcaaaatggagaacttaaaaggggaaatctagaacattgaacccaacattatacaatgatataagaacgaaaagacgaagacaataaggtccatgggatttacccaaatgaggacctaaatcaccgggaagaagtaagtaaacataacgatatagttttagattatcgagaagtcgaagaagaccgggataggtaacagataatcgacgtttgggaagacggtaacgtaagaaactgaggaggttaaagaactaagaatcaacaacaagaaactattgtccctattctacttaggtatctgctagtatgcgatatggaagttaaagaggaaacagtagtatgcactgtttgagaaaattaggatttaagaggtggagaagtcgttagtttggaagcatagatagttcaaatatccacagaaggctattaaaagatagaagagagtcgagagatcgattttaaagtctgagtcgaaatagtttggtgcaagattatccattcaattcttatcgaaaacttacaaggtcaacaagtagagatagcaatataactaaaagctatctattgaacataaatgcgcgactacagcttgcgggttaacacggtcgtcttcattatacgtttaatcgacgccggcttattcatgcagatatttaactcaatcttcgataggatagaggacgtagtagacttggatgtctgtcatccagacatgagacatatacttatatggataatggtagtgcagcaaagtcgtataatttaaacggtatgggacgaagctaacaacatagaggtggacaacgtatagcaggtaattgttaaacttgttctggaaataaagaaagaaatcttttggactatgggcgtggcattagtatcaagagtagtcttggtttgtattatattggcagtgagcttattcgtaatagacgtaatctgtcgcacttacgtttagccaaattaggtccgtgaaacagacacaaacctatatttatgtggccacggacaaacgaaaactataagctacttcgcattctgaggtcttgttgggctaataatagactgcaatcacgttgctggg

SEQ ID NO: 148 - DNA, 889 bp, Artificial Sequence
  transcript variant
gtgccaaattagcgaacaatttgagaagagcagtgagacgatgaaacttgagaaatcgcactggcttacatatacacgataaaagactttaatacaatataagaagtcgttattgaagacggagatgtatgttaccgcccaattttagagatacaaaatgagactgacatagcggttaactatattagagcacgcctaagcattgaaggtttagtcatcttcattagagtatactgtattgacggctgaatgcaaataaattgagacaaaaccgatttcttgaattagcacgaagtaagtataaaactagtagagtgacaccaagtatatagggggtttatatcgcgtgtttaataacaaattaagtgacttatcgcggaagagagaacaatagattggattaaaaagttgtagtaaaccacaacgaagttaggtagctggtaaggttatagatgcgttctgtcgttgtagtcccaatgaacatagtatggtttcgcatagtaactgacctaaaagaccgccacatagtgaaaatacttaaaacgcaagtttcataggattaagtggtagaggctatagaaaatgatatcataactataacgaatataacagcaaattaaaatgataataaaaattaaactaatatttgtagttagtgtcaggcgaaatggaagtaatagatgattcatggacgataagtcattaagacatcgaagactgttttggatgtagacatatttgtagaacattaaagaaagatatgagttctttatttcaaaaacatagatggttggctggttagcaacgtcaaagcccacagtatctaatgttgttatggcagaaacagacaaaatatcaggctacaaaaatgtatcagagcattaacatg

SEQ ID NO: 149 - DNA, 10643 bp, Artificial Sequence
  SIRV1-GENE
  misc_feature (241)..(401): n is a, c, g, or t
  misc_feature (762)..(852): n is a, c, g, or t
  misc_feature (1200)..(1277): n is a, c, g, or t
  misc_feature (1362)..(3829): n is a, c, g, or t
  misc_feature (4092)..(4830): n is a, c, g, or t
  misc_feature (5307)..(10159): n is a, c, g, or t
gtgaggcatctataccgccacgccctatgtctttctcacgtataggtgtgctctcagctgccgttccggcgctgcttcacccctttccgcttatcgcggatggtaaagtcaaagtttactcagcggtcgctgttgacctcaggttctctatcaaaaatttgctggctaaaacggtcggagcttctgctccactctttccagcaatccttctgccagtcgccttcaaacttgcaatctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattcgtcgaacgtccgggtagtatagttatctgcatcgtggtcaccagtatcacagactacaaaatctcaatcctccattcccccgtcaggtctatctaaaattcaatcgctgtgtttgcggggtaaataataggacaagtccgtataatctacccaatcgcattcattccagtcagagggtaccaccgaatttcatcaacaacattaataattccataggaactacattcttaaatccttggaactccaaactcctaccttatcacggttctatccgtcgtcttagggtcggtctcctcgtagcatggcctcgttctcctcgccgtaattgcggtcgaaagtacttcagttatttatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgaggcttgtccgcgagtgtcaaccgggttttacaaaggagaacttccaacatcagtgtatgggatgtttcaaacacccccagagacggagacaatagtgtggtcacgtacatttaggaagataaaaataacaacaacagaaggtgtgaggcgcaaggtacatgctcttaccccactctcagcacgtagggagcggagtgtggaagaccaacaagcccgtcgcctctaccaaatacagctatcctgaggtgccaggttagaataggccctaccacatctaagccttgaaacggtctgttcctcgtgtcaagttctttgtccgcttataccgccatctctcgttgtgnnnnnnnnnnnnnnnnnnnnnnnnnnnnnnnnnnnnnnnnnnnnnnnnnnnnnnnnnnnnnnnnnnnnnnnnnnnnnngtacaagagttggttactctcagtcccattcccaacacatcactgagaagtatagagcctagtggtcattagaaggtcaacatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtaggtgtttaggtgtgtcggagggcagaaaccaacgaaagaaaggaaacgatcaacacttatatagtgtcctgtcgggcccaaatcctaagagaccttaggtttaccacattagtactaaacagcctgttgtataccgtgagcccccacttcgatctgtaaatggtaatcccttgtaaaacctcatctccaaaaacagtatacgcaggtacagctgatgtgatcctctctactagtcttctctgaggaaccatgagatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatagtgggggacctgagtcatactagggtaacttcttatatggtgacatcactcctaccgtagaggggggacggtagtctgtgggaaatctaccctagtgaagaaaggtaagagaatgtctgaacattacctgtagacgaaggtactctcagaacaactactctcacatacggaaaggtttgggtccttggtcaaaggactttactgactctgcagacgatgaatatctgaaccaacactactatcaaagatgtcgtaggtttgtgagaagggagaagaagtggttgagaagttggtgttccacaagttaaagtagacatacctttagtacctgtaaaggttcgactagacctctcgtggtagggcctggaagtcaaaagacttctctatgggtactaggtaggtagttagagtacggtccctggggtgtctcagagtcgaacgttcgggggaagttcctaaacatgttaggatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatgataacaagtccaaacgtggacgtcgtcgctgtcacctctcggaacactagctgaggtggcttaaaaacattccgtaactgagtggtcaccgggggtgaaacatgctgagggttctaccttaacgggaaggtgaaactctccaatgtctttgaaaggactagttgagataacccaaaccgaatccggaggaagaggagaacttggaaaacgttgtacgacgtcattaataacgattccgttcttcccgttcgtgtctataaggatattctttcattgcgaaggtaagcccttttgggtctagatacggactatactcaaaaacccacagaccttccacttggagttgttttaggagacggagtagtagagaaaacttgtggcaccttcccagtcggttccctacagactctccttagtagctcctaagatcgtcgagttacacgacgacattgttccgactgacgtagaggcattacttt

SEQ ID NO: 150 - DNA, 4911 bp, Artificial Sequence
  SIRV2-GENE
  misc_feature (161)..(1111): n is a, c, g, or t
  misc_feature (1225)..(1432): n is a, c, g, or t
  misc_feature (1946)..(2086): n is a, c, g, or t
  misc_feature (2269)..(2537): n is a, c, g, or t
  misc_feature (2807)..(2901): n is a, c, g, or t
  misc_feature (3031)..(3109): n is a, c, g, or t
  misc_feature (3238)..(3847): n is a, c, g, or t
  misc_feature (3939)..(4058): n is a, c, g, or t
  misc_feature (4171)..(4250): n is a, c, g, or t
gttggtgtatttatccgctacgtggtggatgaacatggatgcgaacgacatttcgaaatatacgcaatgatatccaaccctaccgaaacagcaataattgtagaaggtagcatatcatgccgagtcatcgacatgcctttatcgacacacgacgtgattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtttactacgttgtagcgagtttagttgaaatagtttgtgatgtgtaaactaaaacataccaaatggtaaaacttgtcacccccatttacattgcgacagacacagttatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtggatggaagtgtgttcgactgtcaagacccttctataatagtcgaaccagtacggtaagtgggcaacatgcccatataagtcgaagcatttcaaatggttcatccagtagacgacgatgtcctagacagtcatgtctgtcacatctatcacgcctcctacgttgtgccataacgaagaataatagtgataagagacatcgaagctgtcgtagtcgttcgctaaattgcttacaatttagtgctctaagtgaacaatgtttcatcttgagaagcaaacgaagtagaagttgacgacgcattcgaagacgtggacaatgtgacacgagtatcgaaacatgatccaacgaacatcgaagaagttactactgaactacgggtcagcttccccatttgaagtcatgtagtggttgtctactttttcattgaagacgtccacctcaacgctatgaacgttagttgagacaatgttaaagcaaacgacaacgtcattgtgatctacatacacagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatggttagcgtaaacatggtggaacgtactttgactgcgctgcaagaaatggttgggtcgatcgtaatgctagtcgttacatcggaacaagccaaaacaaatcattcgctggatttagacctactgcacgacgacgtcgacacaagacattcttgaaaggtaattgacgtggacgtttcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcaatgcagaaactcctatgcacgtcgaactagtctcttgctcagcgctagtccatgaaaatgtcctagctttgaacgtttatcaaatgcaagttgtgggagttagtcatgtgagagttgtgcaagaaagtgttaacgttctagccgtgctcagtaacaattaccattcggcggtaacaaacgtaagttgtcactgcactcatgagcatgaagttagaccagtagttgggtcagaaattagacgtggtttagtctggttaccgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaagaatagctgaactcaaagaagccgacaaagataaacaaagaagaaacggttaatacgattgaggagaaatattcaatccaacggcaactattaacgtttcaactagaatctacgtttcatacgcgnnnnnnnnnnnnnnnnnnnnnnnnnnnnnnnnnnnnnnnnnnnnnnnnnnnnnnnnnnnnnnnnnnnnnnnnnnnnnnngattccacatccgttcttgcaattaaagaaacgatgtagaaaacgctttggttggcgacaacttgggcggcaaaataattatggtaggtaattgaagtagcgttaaaacgcaaaaagaaggaagcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcactgcaaaaaggactactcaataatggtttctaaagtcattatgctggtgctccctatggcggtggtcagtactgtaactaaagatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattacggcacttgtagagcacgtatcagacccagctttgaaagaaggctgagttcggttcgggtttcacgtaggcctagaacgaggtatagaagtggttaacaaagatttgnnnnnnnnnnnnnnnnnnnnnnnnnnnnnnnnnnnnnnnnnnnnnnnnnnnnnnnnnnnnnnnnnnnnnnnnnnnnnnnngttaccatgtaagaagcggtagacgccatggcctagtaggaagaatgcttgttcacggagccgacgaagttagacgagtggcagaagaaagagcattatcttggtactcggactgaatgcgtactacggtcgtccaagttgcaagaggtattagagtcattcgaatagctgtgggagtggtatttatagcataataagtgtaaaaaacattcccaacagcatatgtgtagccaagaagcgttgtgctcgcgactaaaagtcaggtagcagcaggcattaacccagtgatagaacatcaaagtcaaataagtatggtttagcattactgcgtatcttgcgattgcgtgctggtggtcaacagtgcaaacctagtggcttcgcactcaaatgtagacaagcattaaccaactacttctaacgtatgttcaggaagaatggctattctcgtcaggtgaatgcgtaatcgaatgagtagtatggtcgaacgtcccgctatagtctgacacgattcaggcaaagttggagtgcaaagccatgatttggtcgatgcggcaaatgttgcttaggactattctatggtcttgcgtaattgtgaagatttgccagttatctaaggagacgtggtgattcgctctatagctgtatctaatctgccagattg

SEQ ID NO: 151 - DNA, 8943 bp, Artificial Sequence
  SIRV3-GENE
  misc_feature (168)..(532): n is a, c, g, or t
  misc_feature (765)..(902): n is a, c, g, or t
  misc_feature (1006)..(3003): n is a, c, g, or t
  misc_feature (3081)..(3568): n is a, c, g, or t
  misc_feature (3780)..(5057): n is a, c, g, or t
  misc_feature (7293)..(7755): n is a, c, g, or t
  misc_feature (7976)..(8189): n is a, c, g, or t
  misc_feature (8325)..(8434): n is a, c, g, or t
atgacgagaagcatttcaagaaagcgttgtagcttaaaaagaacgttgcggtgctaaaggagaaagtcgaaaaagcgaaggagttaaaacaaaagccggttattaaatgctggaagaaggaagaacaacaactaaacaaggttgtcaagagcattaaggaagccgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttcaacaatgcccaagttgacattattccaaaacgtttcgtagaaatgaaagcgcttcgagtaattaggcgcaaacttacaggacgccatggcatatgggtggtagaaccaacgatggaagcgagtagcgcaatgccttagcgcacgcctacactaactgcttacgaagttggagcaaaagaaactgaacgtgtcagccaaaattgccaagaaacaggagctaccaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggccaaacaacactcgcaaagaatttatgtgcgcttggcaggtggagaagcaaatacttggataccgaatttagaggccataggttatggaaaaagtcagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtacgaattacgaacaccttaacattagggaaacttagatagttgtacaaagtaacgtataacaagtatcgcgtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattagatagtaaaagtcgaaatctttatattcggttcgatgtactacgttattcgcgactgttctgtcatgatagttttttatatagtcctaataaaaggagtttttaaagtaaatgacatttcagtagtaaaagtttaagagctttttgttctgccagacgttctgatagttgaggaaaacgtgtggtcagctaataacttgtggtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtaaacgaacatccaacagtatgtacaatcgtatgagaaaggacaaatctgaagacgatattagagggagtccaacaagtttgtgatgattcacgtaaggaaatcgaaatgtaagattattcgtcaatggaggtataagacaacacaccaagtaattatacgcgacgagttttcatgttgacgatccctgagactatatcatacaaaattgacccaaataataaactcgttccaatagttgaagtgttgattaacacattgagacaagttgtccgtactttaatcatcaaagttttggactgacctataaatgaaatattcgcgttgtcttcagtttaagaagtgatattattttcggtttcaagcctatgtggagagatacaggaaataggtaaactataactaatataaatatacgcagacgaagcctgttaactttaccaaatccaaatagcgggagacactaaacttacaagaaatgtacggtaagacagggaaacagggtttgaagtttggaggtacaaaatcttaatccttcacaactgaatcaacatttacattcggttacgttcggggtttgtagtagtaattgttgaggtaattttaattgcacttacagacgtggatttggtgaaacattatgtggtagattcatatttccgaatcttaatagacgattttatgatggtgatcgtggtttcttttcaaggtttggtggacgaaaatgaaaaaatcacaatttaacgtttcatattcatcacaatccgaaatcgagatggagagaaagtttgactaaactttgttacagtatttttgaaggcaatcaacctggaactttggatttcatcaagtaaacacccatatttagcgaaaatgcaagctaactgcgaactaacaaggtaactctttttcgatttcaaaatatggtcagtagcaatatgttaagtgatccattttggaggggtggggatttgttcaatgaatgaggcaataaaccaccgcaacctctgtaattgacgagaaacttgtataaggtcatcaaaaagaatagatgaacataaagattgaatacggctgggtgaggttaattcagatttcccaaattatgtagatgaaaagatggtaagtttattgataggtaaaaaatcaagagagggtaataaagaagaaagaataatcaaaagatagagcatgcaaacattacatggtagtattgttataggcggtatattggtaaatgacgatccttgacttagttttttacatcgaacggttgcaaatcctagcatacttgatattaatagtagatactgaaatatatctgagtatatcaagggaaatcgagatgtaacaataagtcgaggaaattaaggtcaatttagtgcttatcatagaaataactacttaagcccttaacgaactaactcaaattaacgaggtagaggttattctgaattgtacgaacgtagtcgaagtttgttaccaagggtaaagccaaaacaaaacgatttgacaagagaatctattccatgtagtagtgcgtttgtacgacgttctattcgatgtaaatcattaggacgagggtttgaagcaactcggaaagatggtcggttagaatttaaaagtactgaacggaattaacgaagttggctactacctaatagtctttgcttaggatttagtagttcgcaattgggtcaaagtggtcgctttggtcgtcgacgtcaagactcaacaagtcatttaccgctgtacgaaccatctcatttaacaggttctcaaccaaatagcggtaggagtagaaagcacttaccatcgtacgaactttgacaacgaaaggttcaaaggtaaccaaggcgtagtagtgagttaggtcaatgtataaaaactccctttcttattttgagtcgtcaatgtagtcgagaaagtgtccaagcaaaacgtaacgaaacggttgagtaaggacttgcacactatgcccttgcgggtttacctgcttgacgtagtcctgccacttattatccgtgattgttacctaatggacaacctaatcgttagcttaaagaagatgcacttagtgccattattattagacaagatagtccgttctttagtcgaagttcttgttgtaataacaaaagtagagcagtattttgacgtatagggagacagtcattaggtcattaacccagttactaaggacaacgtaaccatcgaagttattgaacttcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattacgatccgaaatttcatggacacagatatttgagatcaacatttgattcgttgacgtatttatgttgattcggttagcgagagttacaaagttagtaatagaaagaaagaggaaataataatcaaaagattaagcatgcaaacattaagaggacacatatgtattggtggcatttgcgttaggttaacgtctcgtaagacggtgaagctgcttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggttaggtcgcttggtagcatatctgttaccgaagacacgacagtaaattgtcaagcaaacactgcgccttcttcggtcgcataaagaagtgaaccataacgttctcctacttaactccgcaacgaaaaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattcgttcaacatgaagtggcttatgttcgcggagtagtagcgcgtaaaagtgtaggtacgcgagctatcgtgcggtgtagcatcgcagtcaaagcttgcgtaggtagcgttgcaatctcctgtactaaagacatgcaactgccagcttgtactgttggcgaagaaagttcagtggatgttactaaccgcgtttaacgcgtggacacggcggcagttgagccaatcgattacgaaacaagctatgctaatgttgaccatttggctcttcgaccagcagtcagccgcttctttacctgccaacgttgttcataacaggcaaaaccagaaagtcgcataggttggtcaactttcgcagaaccaactgttactgcgatcttcagcttgccttttgtcccagattaacgtgtaattattaaacaaagttcggcagttccagtcgctatcgacaaaaccgaaaccacaagttctgtaattacgcgttcggcaaagcgcaatgcgccctaatac

SEQ ID NO: 152 - DNA, 14122 bp, Artificial Sequence
  SIRV4-GENE
  misc_feature (204)..(499): n is a, c, g, or t
  misc_feature (531)..(1185): n is a, c, g, or t
  misc_feature (1451)..(6132): n is a, c, g, or t
  misc_feature (6494)..(6750): n is a, c, g, or t
  misc_feature (6881)..(7204): n is a, c, g, or t
  misc_feature (7254)..(7454): n is a, c, g, or t
  misc_feature (7482)..(9283): n is a, c, g, or t
  misc_feature (10116)..(11019): n is a, c, g, or t
  misc_feature (12872)..(13237): n is a, c, g, or t
  misc_feature (13668)..(13776): n is a, c, g, or t
gtgaaaggtgatacatatttacttgacttcttaagcagagagcgtcaaaacaggttgaacttatacagaaatactaaaagtcgaacaaccattcgatttaggaatacagaacgataacgcagcagaagtagttgaccaccgtgtaacttgaatggtgatggtcctggttctattaatacaaatccttttacttatgctccgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaattaggatcaggtggttaatctgatacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaaggtgaaccaggacgaagtcgatgtttcagaacctcctttaggccttttagacggtttaaacgaagcactagaccaagtaataaaagcggacgttgcacaggtacgtgcagatacagaacaactaaaagaactaaaagagaagaacgacgtgcacgtgctaattatgcgaattaacatcgggttagaaaaagtaaactaaaggaaaatgggtaaggcatatgccttactaaattgtgtaaaagaagttctaataagaaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatgtatgtaattattcgcaagggttccataaggcacatatacaaatttagaaacaacccgttacattaacaaaggtgaacggtgtttcacagatattagaccattaggtaaccaatgacatttcactatcgaaaagggtatagtattaactactacaactaatccgactcgtcgaggtgatttatacaggactgcaggtagcaaacgacgaggtggacgagggtaaggtggccgacgaaagggaggacatgcacctagttgaacacgactaggaggacgatggccactacggagtggaacacaaaggtaaagttgcaataataaccagtacaacaaaagcatacgtggaaggtgacaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaacgatgtcttgaacaacaccgtcttcattgtttaccatttgctgttggatttgatatttagagcgtatgttgaagaagttggaactctggacacattagagacttattggatcgatcaagaggaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatacgaagtagtttcactttcgtaggttaccctataacacgcaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgtaatcaacctcttattaatcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtaaccatcttacggatgtaatctaacgtaaacaccagagaaacaaccatcaaaacggcataatgggcaagcattattaggaacatctaaatataaaaccattgccttaactcacataacgctacacttggtaacaccaccatatgcagtgcaagaacgttgggtaagagaacatcgaacgtatggtctgtttacataagctcaaaaataattttacagggtaaaacgtcaatcattacttaacagcagtaatgcttacaaatgtttcggttagtatttaaaaccgtaacgaacgccacgtgtaaaaacaagaggttttattaatattgggtatattagatgtatccgtcgattaacccaccataaccaaactaaattaaagcaacgacttatgcgaaatcctccttgtttacaaactaacagtaatgcaagtcgtaataaacgtcttaaatattttataggtaaaagatttggaccatatcctcagtactgtaatgataaacaccgacgaagtctacatcgttgcaacggaaaattccatgaaagtcgtatgttttatggtaaacttccgaatttagcaaaaagggttgtaaaaggtatacgtcatcatggtaagaaatacagctgtattagtatataaggttgtagaaaaccacataataatatgtctttagcactagacatcagatgttaatgacctaacgattatagtgctgaacaacgtctacgacaatataaacctttgcaaagactggtcaaacatcaatgttaaacacgtccagataaaagcaaaaaggtaagacgaggattacggaataattaatatagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgttccaatcggcccggcttcagtcattcccggtggcgaagccatgtcaccaataaaaactatcggcggcaatggaagtggtttttcggaaactgttacgggtgcaagcggccccagtgcagtttgtgccttgccaatcggcccagctttcaaacgcaaagttggacgacttattggcccattctgacaacgtcctgttaaactgcccggacgttcaaacggcggtatcggacgactaacgcgttacggcggacaactcgcccccagtcaacaacttggacacggtaaatttgaacgctaagtcaactgtagcagttaaacattgagtattaaaatagatttaagctagcgttaagaacattaaaaactaaccagccaaaccaaggattacggctgtggtgtaatcgattgcgaaatagcatgacaaaaaacttacagtttagaaggtggcggtattacttaagaacatttaaaaatagcctgttaacttcaagctgtagtagcctaaacaggtttcctaatagtatgcaaacaacatagttcaatagaagttattaataaacatcaaattgtctttgaacaacacaaacacgtaagctttcggcaactaaattaactaaaaaataactataattacacagaacacgaagtcatctgtttcctattaaaaaataggtacttgacaggttacaatataacctgtttctagcatgtataacaaaattaagcgacgaccgagcgacgacaacaagcagcagccaggtgggcaaaaggctaagactgctttgatgtcctgagccaacttgccgatacgcagcaacattttagaaacgtcatcctgaccgccgccgccattgccataaatgatagcttggcggtagccgcccaaaactatgaaaaaaattaaattaaggaaagacataaacaaggtagttaagccatgcacctagaaaattttgaacggctcagctgcaacatattagcgctagaaatgacctaccataatgatatagaagataattaccattactgccaccgcctcctccgctgccgcctcctccatagcagcttctattcaaacaaactccgccgccgccaccgccgccataaccaccaccataaccaccgccgtatacacaaacgccgctccttctaagtcttagctattaataacaaccgtggaaacaaaaaacgtaatataggctacagctgtgtcaacagccaaatccataacaacaaaatccatggtgactgtaacagacactgttacaaccatattattaactagatagtggttacagataatcatgcagcaacaacatataaagaagacggttaaagttattgacttatgttagcatgtgcaaattaacataggctagtcttaacctgactcgctgtcgcgactggcatgcaaagtttgacacgccgcggctctagtacgcgtcatctttcagctgtaataactacaaacacatcaaaaaaagtcggtttaaaacaacttgtgaaacgtcaacttggtaaataaacctattattaaagaatctagatcaatgtccaaaaagattatttccattgttacgtctaaatacagattctgcgaaaacaagccattagtatagtagaagaactaaccatcgtatgttcgtgaacgtcgagtcaaagtggctacatgaacaacgattgccacaagcatggtcagtgtcagacttctagcttcatcgggtcgtctaagagtggaaagtccatgacgagcaattggaatggcaatttgaagaggtactcttccgacagttggagtggtctccgcctttgccgttgtaaccaatccaataaaccgcatctgtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagcgcgtccgtcaacttcacactggttccgtagtcctaacgttgtagtctgtgcagatgaagaacgaggtcaacaacgaggtcacgtatgagataccgtcggtagtccatgacacccgaaaggtcacgtcaactaagcaattgaagttgcaattacctcttcggtactggaaattgggcacccaaccaagcgaaccgaaaccacactcgttacggtggctcgtcgttgacgacctgctggtaaagcagaaggtacgcgaagttaacgaaccagaccaagtatcggtcgaatccgaattgtcttagttacagtgggacttgcagtacgacgtatcgttgccacaatgcccgttattgtcaccacagctaatggtgaaccaagaacagccagactcatggtcaacgtaatccactgactgggccacgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccaccggagggttgctagaccctaacgtgggagacgctctatccacagctacatcattcagaagagaaagaagagggtcttctacaggggacattgcagctaacacgctggttgttcgttgcgtagacgacacttgttctgtcgctaccgaggcaagtaaagtcgccaacgtagtatcgccaatggtaacagtagcaatctgtcattcaccacgcgaactggactatgtttaaatccctttgccaatcttccctattgtcccgtcaacttccttctgtcttgctttggtaagtgtcaacgtggcctgaccgaatatcacattcagaacagttgctatgctacac

SEQ ID NO: 153 - DNA, 12606 bp, Artificial Sequence
  SIRV-5 GENE
  misc_feature (150)..(925): n is a, c, g, or t
  misc_feature (1489)..(2298): n is a, c, g, or t
  misc_feature (2405)..(2483): n is a, c, g, or t
  misc_feature (2644)..(4380): n is a, c, g, or t
  misc_feature (4451)..(4543): n is a, c, g, or t
  misc_feature (4627)..(5111): n is a, c, g, or t
  misc_feature (5170)..(5327): n is a, c, g, or t
  misc_feature (5453)..(5658): n is a, c, g, or t
  misc_feature (5723)..(5826): n is a, c, g, or t
  misc_feature (5958)..(6144): n is a, c, g, or t
  misc_feature (6308)..(6681): n is a, c, g, or t
  misc_feature (6763)..(6870): n is a, c, g, or t
  misc_feature (7586)..(9858): n is a, c, g, or t
  misc_feature (9992)..(10133): n is a, c, g, or t
ggaccgaagcatactgcaagacttgtaggcccatgaattacccgcttaggcaatgggtagacctttccttgccgcgtggaacaaaccgccatgagtgttttacgtttacggtcggcgaccggagtcacagcgcgaccaacggggccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggaagccttttagccatcgctatgccgccgctcaaacgcgccgggtgcaaaagcccagagcaaaggcccataggcttttccatcggcacgcgaccgattccatcaagtatagccacggtcgtaacttcgacggcggcaatagtttatggcgctaacacctttccatcgctgagtccaaacgtatgacgtgaggtgttaggtgcaatccccattcgggacggacacgcgagtaaaggtctaacatgtttcaactttccagttagtcgccgtcctatattggcaagaccggatggccgtcaaccagttccattctgactatttgccacattgattaaagaagtaggagcgttagtcggcgcgtgcgcgggactatttagcgaaggtcgccgtatcgcgggtggcggcgtttccgccataacaacaagcgtttaaggtcagagtccgcgacgaatgaaacgccgtgcaagcggctttggtacggccagtttagccaaagcctgatccgttcgccttgggttatcatgtaccagtcaagcggtcatcgcgggcggcgttatcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcgtttgcccgtaaaactaactggcaaaagcctaagtgctgtttcgggtgcaatggtataacttcccacatttagccgaatagcgccaacagcgttattatttgnnnnnnnnnnnnnnnnnnnnnnnnnnnnnnnnnnnnnnnnnnnnnnnnnnnnnnnnnnnnnnnnnnnnnnnnnnnnnnngaaccaagcagtgggcgatgtcagcgacaattccactttggtagaggtcgttcttttgtagaaaacaatctaacataactatgacactttcggtaaattcaccacctttaccagggtcgtaagtggtcaagccacgccgaccacttcataagcattggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatcgcatcgacacaataaaagtacaccaaccagcagaaaacaggtacatatacagtttaacgacctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatctaagatgactacagtagcatagccatagaacatggcactgaaatatcgatgggcgtaaaagtgaacaacgcagacgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattacgacgccaagccactataaatgctaattgagtcgaagaaggtactcctttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacacagatattgcagaagcgggaatgaggttgatattacatcaagtatcaacagacgacctcagaagggtggtcttttaaaatgacaacgtacattaagatgcagacaaacactactatgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgtgaaaatgtcatatgtgcggcaaaaatagacgacatttaagaacctagcattataggatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtgttgtattaattcactctagagtaatggatcacggtgccagaaactaaggtggtgtaggactagatgcaagtaacaacggtcgtactaaaatcagctacgcgatcgccgacttagaaggctgagatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaaacttgtctactggcagacctcactatcttttaggaaggtcacgaagcggctggagtgatggctagtctcagccactgtcaacgggaagcgcgacgtttatggtcaatataaactagcagtttaatccgtatggcgatcttagcggatgttacaggatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaagatgacaaagtagaagctagacaactatatcaaatcgttgtgtggtcttaaaccgacacagtagcattcatcgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgtggaaggtcacagcctcgttggaggagatactacggtcccgcttttcgtgggtgacaaaggtcgcaaaggtttccttagggaggtcgtttcccggatctttatctacatctcctgggtgaaggggatgatctttctctacatgtcctgggtggaggggagtttccttgtatgggtggaacccaacccgccggtgagggtgagttacggtcggcggtcatatgtgggtatgacgggtatgacgtcataaatagtcgttgtcaaaatgggaggtggaagtccttactgtagtcacccgtgaaggtggagaactggcaggacatctctaggtcacctaaacgtgcgaagtgtgcgaaattaccaccgtaaattcgtcctactgaaagtgcttacgcatcttgagagagattgcagagagccaggtcaaatacattgagaaatctgtatatgtactttggtaacgctctaaggtaggtacacgttagtgatataaaaagaaggcgacgacggtagcagaggtctagaaaccgcatgaacgaccaacttatttgaagagctagtgcggtggaattgggtcggaagaacttaaattgttagagcagtttatgggtggtaggttacatctatttacttcaaaacgcggtgccctagcccacaagcattgctttgtaaaattgttgaaggtaacttgtaaaagccgaacatgaacgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatagtagaccgggaagaccaacgttttttcactactccgaaagaacacactgaagggaacggtgtaggttcggtgagtccgggactaggtgtccatgtcggagacctcagtggtgacgtcctcgtagtatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccacgctctaagtcgcttgcccaattgtggctaccgcattgctcagaacttcgggtactggccaaccttcaagaagcctagtcttggtgcgtcaccccagtcacgtagcatacccgtcatcatctatggtcgtaggtccaacaatcgtggcgccattgggtaccacttcatcagagctgctcgcatgaccagctatatctggaacatcgctggtgggtcttatggtcgcttttgtgggaaccatcatagtcgcaagtctggccttcggtatggaactcgtcgtcccgactacaaccatagctagtctcggtctcggctttgttgcaatgcccttcgttactacttcaacggtcgtggtgccggtcaaaccgctcgctaaagcaagcgaagaaacagctaaacttagttgtgtcgaaacatcctaagtggtcgggttgctcgtggagcatgcagctagcccagaacctttagcttgtgtggtcttcgtctcggtagtcagaaccaggtcggtctgaatggttggactcgccacatcaactaggtcagctattgaagtgccaactaaaggtcgtattgaagcaatcggtcctatggcaagtcaagtgacagtcgtaggtatggcacttgccgcgcctccagaactcggtcaagctacctcataactcggaagtcgactgctctaaagcgaagttgtcaaacgaacagctatgccttcgagtaaagcaaggtgcgcaatagtaaccttggtaacttcggaactgcgtcaagccgctaactccatcggtatggaagtcgctaaagtcggtcaaacggaagcggctatcgtcgcaactagtcgaatagttgtcgaagaggccagagcaaccatggttgccattgtcttcgtggtctatgcaagacgtccttgcgtcatggcctaagcatcttcttcactggttgctatagcggaagtcgttaccgaactggtcgccagtcgaatcgtttgccccatggtagtcatcaccaccatcgcggaaaccaacggtccgaactcacggtaggtagtccacgtatgtagcccacctttcgaaggaatcgtggtcgccggtctcctagaaacggtatatgtcttgcgtcacgcttatggaccggtcatcctggccagtagccgacttgtggtcgctatagctttcgctagtccctgccttaacgtgcagcatggtatggctattgtcgtcccggctacaaccactatcgtggtcttgaaactggtcgtcgctacaaccatcctagcattggcaccagcggtcgttgaagccgaaggtagtctctaactggttttcgaagctagtcaaacagtagcgccatatggcctagcctgaaccttagaaaaaggagtcgaaggtcctaaacccgctggtcgcgaacgaacaaaaacggtcgttaaaggccgtccggaagcggaaggtcgtcgccccaggtgaacaagtcctaaagaaacaaaaagtctctgtagtctatttaaaacccaacgcaaacgcgaacgcagaatcgtctgaacccacgtccatcattacggattatataaggtttctgtttcgttaactaggtagttattgatgtcatccgcactacaagctaacaggaggtaacagatagagcatgagtggtagtagggatgaaacaggaagtactaattacatacagggactcctggttgggtgaccccgggacacgtacgtgtcctaataaacaggaggcgggtggtttcctatctactacggacagggattttccccgagtagcgaaggatatgaaacttctagttatagacatataagacgtagtccaggaagtcggctgagtccatgaggtcagttttggaggagaagtagttgtcacgatccttagttaagataacaaagtccgagtagttatcacgacttgctgactgcgtccactatgtttccggggtgggcatggggacttgcacacggataactccatccggattattaagacgaggtggggtgtgctgggctcccaggaacttcatcggagtgacgtagaaccttcagtttgagtccacgtaggacaccagcgctattggtgccgacgacgagtacaaacatccggaaacttagcatattaggtaagagtttctgtatgctcggacgtcgtcgttagagcagacccagaaggtgtccatggacacacatcatacaagacaacttggtcaacttttacggggctggggccaattatcccgggagtcctcacgatcagaaaccgactggtttgtcacactctggttagaggaggggtcaccacgatgggtgagggggtggtgggtgtttatacaagagtctgggactccaaagacgatattacgacgagacgacttatccacgtactttgtttcccaaacccacgcaactccacctttagtccacacaaactagtacgagacacccggattcaaggtcgtgacc

SEQ ID NO: 154 - DNA, 10837 bp, Artificial Sequence
  SIRV6-GENE
  misc_feature (187)..(303): n is a, c, g, or t
  misc_feature (382)..(468): n is a, c, g, or t
  misc_feature (1121)..(1285): n is a, c, g, or t
  misc_feature (1621)..(1740): n is a, c, g, or t
  misc_feature (1829)..(2023): n is a, c, g, or t
  misc_feature (2165)..(6104): n is a, c, g, or t
  misc_feature (6449)..(6805): n is a, c, g, or t
  misc_feature (6924)..(7999): n is a, c, g, or t
ggcaagacgaatctgcgtcaacgctaaaggccgtcaaaaagcaagagggcgtcgcgcctgggaaaaaggtagtcaagaaaccatcaagcttaaatgtcgggaaattgggtttgcgccgccttcaggggcagcgatgggggcgacaattgtggaccgtatggactccattatgctgggactcctcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtagttgttgaaaaagtaggaatatctagcctagatgtcgtttcaggcgaaggactctaaggtcttaaaatcgttggnnnnnnnnnnnnnnnnnnnnnnnnnnnnnnnnnnnnnnnnnnnnnnnnnnnnnnnnnnnnnnnnnnnnnnnnnnnnnnnnnnnnnnngtcaaccgctctaaagcgaagttgttggacaaacagttatgcgtaactgtaaagcaaggtgcccaagtagactcttactaatttgggaacgacggaaagtcgctaccttcatcggtatggctttcgctaaagtcggtcaaatggaagaaggtagtcgaagtactgttgaaagagtagactgagcgacagtcgaaaccagccccaatgaacaagacgccattgcaaaacgtctatacgctacggtcaaagacgcttccacaccacatggtatagtggacgccgttagcctcatgtgtctcactcaaagaccttgcgtcacggtcatcctctttgtcagcaacgtagaaatctccggtctgtcgataccttgcgtaaagctctcatgtagcctaccttacgaagaaatcgcacaagtcggtcgcccagcggtggcatatgtcttgcctaacgtttctagaccgatcagcctcacgagtagcctgcttgtggtgtttatagtttacgctagtccaatctgtatcgtgccgcttggtatggctattgtcggcctggatgcaagcactaacgtggtcatcagactggtctgcgctataatctacgcaatagaggcaccagcggtcgttgaagccgaagacgctatttcggtggcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatattgtttcaatggtcgtggcgctggtcagactgctcgctaaagtcgtcgaagaaacagctagaccatctattctctgaacttcctaagtggtcgggttggtcgtggcgctcatagttagcccagaacgtccagtttatgtggtggtgatcttggttgccagactcagtatggtcaaaatagttgtgctcgccatttcaactagtgcagttgctaaagtgccaactaaggttcgtcttgaagcaatcggtagtatctgcagtcaagtcgtagtcgtaggtatggcacttgtcgtgcgtctaggacgcgttgaagctatcttattgcccgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagccgaaagtctgggacacgtcgtgggacgtatcgttaggactatgggactagtcgtcttcggtcttacaaatgttgcaatgccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctatgcctcgtatcatctatggtcgtaggtaaagcaatagcggaaacattggatgtgacttcatcaggactgctcgtatagtgagctacttatgaaacatgaatggtcggtcttgtggtcgcttttgtcgaaatcaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaacattaaatcaaagaagtttatcaaccaattagtacagtggcatgttaagtaaaacagaaagaacgccaagtggcaacaaatgacgtaattatttaagcaaaaagcgtaaacgcttacaaaggctatttaaatatcagtaaatcgttggaaattgggtatgtgctgccttcatacgcaaaaatggatgcgacagaaacgagttgtatggcctccactacgctcgcctgccgcggaccctaaacgacagtcgtttgcccaactacggctacggcatcgctcagaacttcgggtcttggcccacctttctgacgcctagtcaacgtgcgtcgcctcagtcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacaaaaagaagaaatatcaattgcaaaaataactataggtacttctttgaagaaaccaaacgtgagtttctaacacgactaaatccatttgatctttgagaaagtcgaagacgaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgggtttatatcgcgtatccatccaacttaactgaaacgcgaagcagtagacagtgttgatcgagatttgcgaagggaaacagtaaaagtccagggtgtcgttaattacgacaaaactaaagactgtatagttagaaggatcaattgggctgatttagaaatggtataagttaaagaaatggaaacttattcgacaaaaagaaaaactcatgatgtatagatggaaactgccataatgtcgattcgagttatatttttagattttggtaaaatatccaacatgtattaacgaaattttgaagtatagatcaaactattcttcaggtacagcatcaagcattcggtagcataagccaaacaagtctttgaagggttggacatagcgagttgtgtagaaagttacgaagacttcaacagaaaaagagtttaaaaggaccacgtatgccaaatcgacaacaatatagtcgttctattctgcgatatgtaagatagagacacatcggcaggtagcatagaacttgggtcaattattatttaagtgcggtaacaaacaaacttagggaatattattgtgctacagcaaatgccttgaaaagtcgagaaagactactatactcgtcaagttcgtaaagacttaacagtaattgtaatgcaaatacttagcgagattgattccttcccagtagtcatctttcctttagatattagaacagcaattttagattttgtacatagtggagaaaaggacgtcattttaatggatgaaccagacgttaacgtcatttacttggtcgttgatttcgaagactcagtcatcaaaattgtagcttcgctagctaatgtgcttaaaatcatcatagtcaaagtgtacgtggtcgtggtaataaacaaccttcattactgtacaaaagtgccagtttgttacattatcgaacgctgtatagaggtatcatttcacctatttgacaactaggtgataaaccttcggtcgctagacgttgttgttattgaaaaaatggaagataatctatacttaatccaaaacaacccagaccaagctcgtatataaatggaagtcgtcaaaattggtttcgttcaaataagttgggactgatgaatcagttttctgaacttcaccgctattagcgtcctagttgtctacataattagtatcattattgtagtagtttaaatcgctaacaaccaaaaaatccttgacatgggtaacgacgttattggggaaccaatgctcagtgttggtgaaagaatcgttaggtcgaactattggtacgttctaataaaagacgacatagaaattcgttacataatcaacgtcactactaagggcgtattgcaaattagttcataaattattaacagtttgcacctaatagttctagtccttaaaaaggtagaagacgtaggtaatgtcagttgcctcaatgtagtcaggtaaaaagtatatgtgctgatggcaaacttcatctttgtgagagttgagcatgtataacaacatcactcagtataaccgcttggttacacaattagtatcatgcctatagaacgccttatcattcaggtcgtcgtgatagtgaaggggatcaaagtcaaaatctactttgtcataactctttacggtatcccaatgcttggtataagtgcttaagaaattgtttaaacagaaactcaagtataagcgaaaacaagttacctggaaaaagaagaagtgcgtataattgatgaacgagtcgaagtcgaagttgttcaacaagagagttaggtagtgccgcttgaaaaagtaatagtgcaaataagaaagtaagactgtatcggagacgactttttaatagtagtaattctcggtacaactaaaccagtaatttcagacactgaaatagaggacttcgttaggtacgaagcaagttaactaaatgacaattaaattgagggtaaatatcacaaagaaatcatggaagatttcgaccgaatacaggaaaatttagattaaaggtttgtcgtcgttgaaataagaagaagcgaaacggcattcgtttaacaaaacgtcacatatttaggtatagtagattgcgttcacaaagaaatttaaagtcttgtaattatggtggtcgatttattggtagtatatttggaaatagcatgcaattttggaatggacgaagaacctgacatctgagctattgtaagtttaatttaccatttcgtcattgtatatgcggtaaacgtaaatttacacatatgacacgaactttgagttttattagcctgcctaattgttggtaacaatgtaatggaaattggcgatgactatggggaaagagcaatcaactcaccataaatttgtgaacgcagttaagtaattggcatcgcgcgcctaatcgtttacattcgcatggaacaagaagaaagagacctattcgtgggagtcaatggctatgtggaaaaacatgaactgccaaattcggctaaccaaccagaaatggtcatggaaaattcttgcgtcaaagttcgcggtgacgtttacgaagaagctaaacttgtgcttgtttagaaagttaggtgcgtcctggttttagtaaatttagaaaaccattttgttgtttgcgacagttaaataaaacttaacgacaaagaagtgacttgcgtcgtagattaactggaaattaaagtggtatctaaaatggggtttgccgatgcggtcttcaaagtctaaaattcttgaagtttgcgtttggtcgcaaaaattatggatttagtcgattattgcctactaagcagcagtttagaagtttttaagatagttacgctagaagaccggg

SEQ ID NO: 155 - DNA, 147317 bp, Artificial Sequence
  SIRV7-GENE
  misc_feature (350)..(33329): n is a, c, g, or t
  misc_feature (33638)..(69354): n is a, c, g, or t
  misc_feature (69477)..(77330): n is a, c, g, or t
  misc_feature (77435)..(92220): n is a, c, g, or t
  misc_feature (92469)..(105240): n is a, c, g, or t
  misc_feature (105290)..(135751): n is a, c, g, or t
  misc_feature (135899)..(143200): n is a, c, g, or t
  misc_feature (143284)..(143507): n is a, c, g, or t
  misc_feature (143593)..(144138): n is a, c, g, or t
  misc_feature (144223)..(144421): n is a, c, g, or t
  misc_feature (144509)..(145206): n is a, c, g, or t
  misc_feature (145325)..(145642): n is a, c, g, or t
gtgccaaattagcgaacaatttgagaagagcagtgagacgatgaaacttgagaaatcgcactggcttacatatacacgataaaagactttaatacaatataagaagtcgttattgaagacggagatgtatgttaccgcccaattttagagatacaaaatgagactgacatagcggttaactatattagagcacgcctaagcattgaaggtttagtcatcttcattagagtatactgtattgacggctgaatgcaaataaattgagacaaaaccgatttcttgaattagcacgaagtaagtataaaactagtagagtgacaccaagtatatagggggtttatatcgcgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatcgaacaacatatctatttaattagtttaataacaaattaagtgacttatcgcggaagagagaacaatagattggattaaaaagttgtagtaaaccacaacgaagttaggtagctggtaaggttatagatgcgttctgtcgttgtagtcccaatgaacatagtatggtttcgcatagtaactgacctaaaagaccgccacatagtgaaaatacttaaaacgcaagtttcataggattaagtggtagaggctatagaaaatgatatcataactataacgaatataacagcaaattaaaatgcactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataataaaaattaaactaatatttgtagttagtggtgcagatttgaacgaacagtcaggcgaaatggaagtaatagatgattcatggacgataagtcattaagacatcgaagactgttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgtagacatatttgtagaacattaaagaaagatatgagttctttatttcaaaaacatagatggttggctggttagcaacgtcaaagcccacagtatctaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttatggcagaaacagacaaaatatcaggctacaaaaatgtatcagagcattaacatgaaaaatcctaagagatcgacgaagttatcgactaaattgttgtaatccaagaggctgattgacgtttagaagtaagtggcaatttggtttaaaacaacgataataaaggttgcgaagaaatataaaaagtagtcacataacactgacattattaaatttagatagactttaccgctaaaactgtagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagtggaaaatttcagcaagagagtcgaagtcgtcatagattagcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatttcgaagaacgcgaagaactaaacgaacaagttatgaacgaaattagagtcctaataacctgtttagtgaattgaccagtagtcatataacaaaaacaagaaggttaggcaaagctataagcaaatagcattgaaatagaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgagaagaaggctttaaaatggtagtcgtatgcgaacgctaaggaagagaaattctagtagaactcgtagttacatacttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgaaagaaaagtcgcaaagatcggaaatcaagacgcaaaacaaaacggagaagttcaaatcgaactcgtagaacatatcgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacatattaaactcttggtatcgctcagttacaaaaggagacacgtagacacgaaagaaactggaacaacagacatatttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgttagagcaaattatataaactttcacatgctaaccaacgtaatttgagaagaaatcatcaagaattaaactaaaggaatggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataatggcaattatagttaaaatagtcgtaaattagattatggtgcaccggggtgtaagtttcgaactcggtgaggcaatagtagtatagactaacaacaaggtagacattgcaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattgcgagaagaacttcacgaagatatagatacagtacagaatttctaggattaagtacagcagacgtatttacacctgttataggatacttgttcacttaatccctgttatgacaaagtagtctcatagaatttttagaacgagaagatttgaatggacgtaaaggaagaaggtcaaaatggagaacttaaaaggggaaatctagaacattgaacccaacattatacaatgatataagaacgaaaagacgaagacaataaggtccatgggatttacccaaatgaggacctaaatcaccgggaagaagtaagtaaacataacgatatagttttagattatcgagaagtcgaagaagaccgggataggtaacagataatcgacgtttgggaagacggtaacgtaagaaactgaggaggttaaagaactaagaatcaacaacaagaaactattgtccctattctacttaggtatctgctagtatgcgatatggaagttaaagaggaaacagtagtatgcactgtttgagaaaattaggatttaagaggtggagaagtcgttagtttggaagcatagatagttcaaatatccacagaaggctattaaaagatagaagagagtcgagagatcgattttaaagtctgagtcgaaatagtttggtgcaagattatccattcaattcttatcgaaaacttacaaggtcaacaagtagagatagcaatataactaaaagctatctattgaacataaatgcgcgactacagcttgcgggttaacacggtcgtcttcattatacgtttaatcgacgccggcttattcatgcagatatttaactcaatcttcgataggatagaggacgtagtagacttggatgtctgtcatccagacatgagacatatacttatatggataatggtagtgcagcaaagtcgtataatttaaacggtatgggacgaagctaacaacatagaggtggacaacgtatagcaggtaattgttaaacttgttctggaaataaagaaagaaatcttttggactatgggcgtggcattagtatcaagagtagtcttggtttgtattatattggcagtgagcttattcgtaatagacgtaatctgtcgcacttacgtttagccaaattaggtccgtgaaacagacacaaacctatatttatgtggccacggacaaacgaaaactataagctacttcgcattctgaggtcttgttgggctaataatagactgcaatcacgttgctggggtggtatccttaactaacaatatggtaagtacggtgatagtgacattcaaaatagggtggtaacttagcatggtctacttggtggcagaagtggaagtggtagttatattcagctttatggttttacactgtatatttcacttggcggtcgccacaataaagatttagaatccactggcagaaagtcagcgcatttttatagcagacaacttgcaaagggagaggttcatgcaacgtgttatggtggatcaagttatcttagtaagacataaacttgtatagacaataacagtggcggaaattaaggttaagataattgtaactatagttccgggagagaactatttaattccgacaactgttatagccaaaatagatgaaatagagcgtataaaacctattcttccaagcgtaat

SEQ ID NO: 156 - DNA, 248 bp, Artificial Sequence
  exon
ttgttatggcagaaacagacaaaatatcaggctacaaaaatgtatcagagcattaacatgaaaaatcctaagagatcgacgaagttatcgactaaattgttgtaatccaagaggctgattgacgtttagaagtaagtggcaatttggtttaaaacaacgataataaaggttgcgaagaaatataaaaagtagtcacataacactgacattattaaatttagatagactttaccgctaaaactgtagtt

SEQ ID NO: 157 - DNA, 66 bp, Artificial Sequence
  exon
ttgttatggcagaaacagacaaaatatcaggctacaaaaatgtatcagagcattaacatgaaaaat

SEQ ID NO: 158 - DNA, 65 bp, Artificial Sequence
  exon
ttgttatggcagaaacagacaaaatatcaggctacaaaaatgtatcagagcattaacatgaaaaa

SEQ ID NO: 159 - DNA, 104 bp, Artificial Sequence
  exon
gatgtagacatatttgtagaacattaaagaaagatatgagttctttatttcaaaaacatagatggttggctggttagcaacgtcaaagcccacagtatctaatg

SEQ ID NO: 160 - DNA, 68 bp, Artificial Sequence
  exon
gtcaggcgaaatggaagtaatagatgattcatggacgataagtcattaagacatcgaagactgttttg

SEQ ID NO: 161 - DNA, 122 bp, Artificial Sequence
  exon
gataataaaaattaaactaatatttgtagttagtggtgcagatttgaacgaacagtcaggcgaaatggaagtaatagatgattcatggacgataagtcattaagacatcgaagactgttttg

SEQ ID NO: 162 - DNA, 58 bp, Artificial Sequence
  exon
ggctatagaaaatgatatcataactataacgaatataacagcaaattaaaatgcactg

SEQ ID NO: 163 - DNA, 236 bp, Artificial Sequence
  exon
gattggattaaaaagttgtagtaaaccacaacgaagttaggtagctggtaaggttatagatgcgttctgtcgttgtagtcccaatgaacatagtatggtttcgcatagtaactgacctaaaagaccgccacatagtgaaaatacttaaaacgcaagtttcataggattaagtggtagaggctatagaaaatgatatcataactataacgaatataacagcaaattaaaatgcactg

SEQ ID NO: 164 - DNA, 276 bp, Artificial Sequence
  exon
gtttaataacaaattaagtgacttatcgcggaagagagaacaatagattggattaaaaagttgtagtaaaccacaacgaagttaggtagctggtaaggttatagatgcgttctgtcgttgtagtcccaatgaacatagtatggtttcgcatagtaactgacctaaaagaccgccacatagtgaaaatacttaaaacgcaagtttcataggattaagtggtagaggctatagaaaatgatatcataactataacgaatataacagcaaattaaaatg

SEQ ID NO: 165 - DNA, 308 bp, Artificial Sequence
  exon
gaatcgaacaacatatctatttaattagtttaataacaaattaagtgacttatcgcggaagagagaacaatagattggattaaaaagttgtagtaaaccacaacgaagttaggtagctggtaaggttatagatgcgttctgtcgttgtagtcccaatgaacatagtatggtttcgcatagtaactgacctaaaagaccgccacatagtgaaaatacttaaaacgcaagtttcataggattaagtggtagaggctatagaaaatgatatcataactataacgaatataacagcaaattaaaatgcactg

SEQ ID NO: 166 - DNA, 310 bp, Artificial Sequence
  exon
gatgaaacttgagaaatcgcactggcttacatatacacgataaaagactttaatacaatataagaagtcgttattgaagacggagatgtatgttaccgcccaattttagagatacaaaatgagactgacatagcggttaactatattagagcacgcctaagcattgaaggtttagtcatcttcattagagtatactgtattgacggctgaatgcaaataaattgagacaaaaccgatttcttgaattagcacgaagtaagtataaaactagtagagtgacaccaagtatatagggggtttatatcgcgtg

SEQ ID NO: 167 - DNA, 349 bp, Artificial Sequence
  exon
gtgccaaattagcgaacaatttgagaagagcagtgagacgatgaaacttgagaaatcgcactggcttacatatacacgataaaagactttaatacaatataagaagtcgttattgaagacggagatgtatgttaccgcccaattttagagatacaaaatgagactgacatagcggttaactatattagagcacgcctaagcattgaaggtttagtcatcttcattagagtatactgtattgacggctgaatgcaaataaattgagacaaaaccgatttcttgaattagcacgaagtaagtataaaactagtagagtgacaccaagtatatagggggtttatatcgcgtg

SEQ ID NO: 168 - DNA, 1675 bp, Artificial Sequence
  exon
tattgcgagaagaacttcacgaagatatagatacagtacagaatttctaggattaagtacagcagacgtatttacacctgttataggatacttgttcacttaatccctgttatgacaaagtagtctcatagaatttttagaacgagaagatttgaatggacgtaaaggaagaaggtcaaaatggagaacttaaaaggggaaatctagaacattgaacccaacattatacaatgatataagaacgaaaagacgaagacaataaggtccatgggatttacccaaatgaggacctaaatcaccgggaagaagtaagtaaacataacgatatagttttagattatcgagaagtcgaagaagaccgggataggtaacagataatcgacgtttgggaagacggtaacgtaagaaactgaggaggttaaagaactaagaatcaacaacaagaaactattgtccctattctacttaggtatctgctagtatgcgatatggaagttaaagaggaaacagtagtatgcactgtttgagaaaattaggatttaagaggtggagaagtcgttagtttggaagcatagatagttcaaatatccacagaaggctattaaaagatagaagagagtcgagagatcgattttaaagtctgagtcgaaatagtttggtgcaagattatccattcaattcttatcgaaaacttacaaggtcaacaagtagagatagcaatataactaaaagctatctattgaacataaatgcgcgactacagcttgcgggttaacacggtcgtcttcattatacgtttaatcgacgccggcttattcatgcagatatttaactcaatcttcgataggatagaggacgtagtagacttggatgtctgtcatccagacatgagacatatacttatatggataatggtagtgcagcaaagtcgtataatttaaacggtatgggacgaagctaacaacatagaggtggacaacgtatagcaggtaattgttaaacttgttctggaaataaagaaagaaatcttttggactatgggcgtggcattagtatcaagagtagtcttggtttgtattatattggcagtgagcttattcgtaatagacgtaatctgtcgcacttacgtttagccaaattaggtccgtgaaacagacacaaacctatatttatgtggccacggacaaacgaaaactataagctacttcgcattctgaggtcttgttgggctaataatagactgcaatcacgttgctggggtggtatccttaactaacaatatggtaagtacggtgatagtgacattcaaaatagggtggtaacttagcatggtctacttggtggcagaagtggaagtggtagttatattcagctttatggttttacactgtatatttcacttggcggtcgccacaataaagatttagaatccactggcagaaagtcagcgcatttttatagcagacaacttgcaaagggagaggttcatgcaacgtgttatggtggatcaagttatcttagtaagacataaacttgtatagacaataacagtggcggaaattaaggttaagataattgtaactatagttccgggagagaactatttaattccgacaactgttatagccaaaatagatgaaatagagcgtataaaacctattcttccaagcgtaat

SEQ ID NO: 169 - DNA, 118 bp, Artificial Sequence
  exon
gataatggcaattatagttaaaatagtcgtaaattagattatggtgcaccggggtgtaagtttcgaactcggtgaggcaatagtagtatagactaacaacaaggtagacattgcaatg

SEQ ID NO: 170 - DNA, 87 bp, Artificial Sequence
  exon
gatgttagagcaaattatataaactttcacatgctaaccaacgtaatttgagaagaaatcatcaagaattaaactaaaggaatggtg

SEQ ID NO: 171 - DNA, 84 bp, Artificial Sequence
  exon
gaacatattaaactcttggtatcgctcagttacaaaaggagacacgtagacacgaaagaaactggaacaacagacatatttgtg

SEQ ID NO: 172 - DNA, 85 bp, Artificial Sequence
  exon
gacgaaagaaaagtcgcaaagatcggaaatcaagacgcaaaacaaaacggagaagttcaaatcgaactcgtagaacatatcgctg

SEQ ID NO: 173 - DNA, 49 bp, Artificial Sequence
  exon
gaagtggaaaatttcagcaagagagtcgaagtcgtcatagattagcatg

SEQ ID NO: 174 - DNA, 95 bp, Artificial Sequence
  exon
gaagtgcgtataattgatgaacgagtcgaagtcgaagttgttcaacaagagagttaggtagtgccgcttgaaaaagtaatagtgcaaataagaaa

SEQ ID NO: 175 - DNA, 65 bp, Artificial Sequence
  exon
gaagtgcgtataattgatgaacgagtcgaagtcgaagttgttcaacaagagagttaggtagtgcc

SEQ ID NO: 176 - DNA, 385 bp, Artificial Sequence
  exon
gaagtgcgtataattgatgaacgagtcgaagtcgaagttgttcaacaagagagttaggtagtgccgcttgaaaaagtaatagtgcaaataagaaagtaagactgtatcggagacgactttttaatagtagtaattctcggtacaactaaaccagtaatttcagacactgaaatagaggacttcgttaggtacgaagcaagttaactaaatgacaattaaattgagggtaaatatcacaaagaaatcatggaagatttcgaccgaatacaggaaaatttagattaaaggtttgtcgtcgttgaaataagaagaagcgaaacggcattcgtttaacaaaacgtcacatatttaggtatagtagattgcgttcacaaagaaatttaaa

SEQ ID NO: 177 - DNA, 98 bp, Artificial Sequence
  exon
gaagaagtgcgtataattgatgaacgagtcgaagtcgaagttgttcaacaagagagttaggtagtgccgcttgaaaaagtaatagtgcaaataagaaa

SEQ ID NO: 178 - DNA, 581 bp, Artificial Sequence
  exon
ggggaaccaatgctcagtgttggtgaaagaatcgttaggtcgaactattggtacgttctaataaaagacgacatagaaattcgttacataatcaacgtcactactaagggcgtattgcaaattagttcataaattattaacagtttgcacctaatagttctagtccttaaaaaggtagaagacgtaggtaatgtcagttgcctcaatgtagtcaggtaaaaagtatatgtgctgatggcaaacttcatctttgtgagagttgagcatgtataacaacatcactcagtataaccgcttggttacacaattagtatcatgcctatagaacgccttatcattcaggtcgtcgtgatagtgaaggggatcaaagtcaaaatctactttgtcataactctttacggtatcccaatgcttggtataagtgcttaagaaattgtttaaacagaaactcaagtataagcgaaaacaagttacctggaaaaagaagaagtgcgtataattgatgaacgagtcgaagtcgaagttgttcaacaagagagttaggtagtgccgcttgaaaaagtaatagtgcaaataagaaa

SEQ ID NO: 179 - DNA, 96 bp, Artificial Sequence
  exon
agtagactgagcgacagtcgaaaccagccccaatgaacaagacgccattgcaaaacgtctatacgctacggtcaaagacgcttccacaccacatgg

SEQ ID NO: 180 - DNA, 95 bp, Artificial Sequence
  exon
agtagactgagcgacagtcgaaaccagccccaatgaacaagacgccattgcaaaacgtctatacgctacggtcaaagacgcttccacaccacatg

SEQ ID NO: 181 - DNA, 310 bp, Artificial Sequence
  exon
agtagactgagcgacagtcgaaaccagccccaatgaacaagacgccattgcaaaacgtctatacgctacggtcaaagacgcttccacaccacatggtatagtggacgccgttagcctcatgtgtctcactcaaagaccttgcgtcacggtcatcctctttgtcagcaacgtagaaatctccggtctgtcgataccttgcgtaaagctctcatgtagcctaccttacgaagaaatcgcacaagtcggtcgcccagcggtggcatatgtcttgcctaacgtttctagaccgatcagcctcacgagtagcctg

SEQ ID NO: 182 - DNA, 1969 bp, Artificial Sequence; identical to SEQ ID NO: 125
  exon

SEQ ID NO: 183 - DNA, 278 bp, Artificial Sequence
  exon
ttactaatttgggaacgacggaaagtcgctaccttcatcggtatggctttcgctaaagtcggtcaaatggaagaaggtagtcgaagtactgttgaaagagtagactgagcgacagtcgaaaccagccccaatgaacaagacgccattgcaaaacgtctatacgctacggtcaaagacgcttccacaccacatggtatagtggacgccgttagcctcatgtgtctcactcaaagaccttgcgtcacggtcatcctctttgtcagcaacgtagaaatctc

SEQ ID NO: 184 - DNA, 118 bp, Artificial Sequence
  exon
gacaaaaagaagaaatatcaattgcaaaaataactataggtacttctttgaagaaaccaaacgtgagtttctaacacgactaaatccatttgatctttgagaaagtcgaagacgaatg

SEQ ID NO: 185 - DNA, 267 bp, Artificial Sequence
  exon
gtcaaccgctctaaagcgaagttgttggacaaacagttatgcgtaactgtaaagcaaggtgcccaagtagactcttactaatttgggaacgacggaaagtcgctaccttcatcggtatggctttcgctaaagtcggtcaaatggaagaaggtagtcgaagtactgttgaaagagtagactgagcgacagtcgaaaccagccccaatgaacaagacgccattgcaaaacgtctatacgctacggtcaaagacgcttccacaccacatg

SEQ ID NO: 186 - DNA, 73 bp, Artificial Sequence
  exon
gtcaaccgctctaaagcgaagttgttggacaaacagttatgcgtaactgtaaagcaaggtgcccaagtagact

SEQ ID NO: 187 - DNA, 78 bp, Artificial Sequence
  exon
ggtagttgttgaaaaagtaggaatatctagcctagatgtcgtttcaggcgaaggactctaaggtcttaaaatcgttgg

SEQ ID NO: 188 - DNA, 49 bp, Artificial Sequence
  exon
gggcgacaattgtggaccgtatggactccattatgctgggactcctcgg

SEQ ID NO: 189 - DNA, 56 bp, Artificial Sequence
  exon
gcgatgggggcgacaattgtggaccgtatggactccattatgctgggactcctcgg

SEQ ID NO: 190 - DNA, 62 bp, Artificial Sequence
  exon
ggggcagcgatgggggcgacaattgtggaccgtatggactccattatgctgggactcctcgg

SEQ ID NO: 191 - DNA, 99 bp, Artificial Sequence
  exon
gcttaaatgtcgggaaattgggtttgcgccgccttcaggggcagcgatgggggcgacaattgtggaccgtatggactccattatgctgggactcctcgg

SEQ ID NO: 192 - DNA, 58 bp, Artificial Sequence
  exon
tgagctacttatgaaacatgaatggtcggtcttgtggtcgcttttgtcgaaatcaccg

SEQ ID NO: 193 - DNA, 59 bp, Artificial Sequence
  exon
gtgagctacttatgaaacatgaatggtcggtcttgtggtcgcttttgtcgaaatcaccg

SEQ ID NO: 194 - DNA, 49 bp, Artificial Sequence
  exon
ggactatgggactagtcgtcttcggtcttacaaatgttgcaatgccctg

SEQ ID NO: 195 - DNA, 88 bp, Artificial Sequence
  exon
gagccgaaagtctgggacacgtcgtgggacgtatcgttaggactatgggactagtcgtcttcggtcttacaaatgttgcaatgccctg

SEQ ID NO: 196 - DNA, 74 bp, Artificial Sequence
  exon
gagccgaaagtctgggacacgtcgtgggacgtatcgttaggactatgggactagtcgtcttcggtcttacaaat

SEQ ID NO: 197 - DNA, 186 bp, Artificial Sequence
  exon
ggcaagacgaatctgcgtcaacgctaaaggccgtcaaaaagcaagagggcgtcgcgcctgggaaaaaggtagtcaagaaaccatcaagcttaaatgtcgggaaattgggtttgcgccgccttcaggggcagcgatgggggcgacaattgtggaccgtatggactccattatgctgggactcctcgg

SEQ ID NO: 198 - DNA, 104 bp, Artificial Sequence
  exon
ggttcgtcttgaagcaatcggtagtatctgcagtcaagtcgtagtcgtaggtatggcacttgtcgtgcgtctaggacgcgttgaagctatcttattgcccgaag

SEQ ID NO: 199 - DNA, 148 bp, Artificial Sequence
  exon
gtgctcgccatttcaactagtgcagttgctaaagtgccaactaaggttcgtcttgaagcaatcggtagtatctgcagtcaagtcgtagtcgtaggtatggcacttgtcgtgcgtctaggacgcgttgaagctatcttattgcccgaag

SEQ ID NO: 200 - DNA, 150 bp, Artificial Sequence
  exon
ttgtgctcgccatttcaactagtgcagttgctaaagtgccaactaaggttcgtcttgaagcaatcggtagtatctgcagtcaagtcgtagtcgtaggtatggcacttgtcgtgcgtctaggacgcgttgaagctatcttattgcccgaag

SEQ ID NO: 201 - DNA, 70 bp, Artificial Sequence
  exon
ttgtgctcgccatttcaactagtgcagttgctaaagtgccaactaaggttcgtcttgaagcaatcggtag

SEQ ID NO: 202 - DNA, 151 bp, Artificial Sequence
  exon
gttgtgctcgccatttcaactagtgcagttgctaaagtgccaactaaggttcgtcttgaagcaatcggtagtatctgcagtcaagtcgtagtcgtaggtatggcacttgtcgtgcgtctaggacgcgttgaagctatcttattgcccgaag

SEQ ID NO: 203 - DNA, 190 bp, Artificial Sequence
  exon
tattctctgaacttcctaagtggtcgggttggtcgtggcgctcatagttagcccagaacgtccagtttatgtggtggtgatcttggttgccagactcagtatggtcaaaatagttgtgctcgccatttcaactagtgcagttgctaaagtgccaactaaggttcgtcttgaagcaatcggtagtatctgc

SEQ ID NO: 204 - DNA, 335 bp, Artificial Sequence
  exon
gaatattgtttcaatggtcgtggcgctggtcagactgctcgctaaagtcgtcgaagaaacagctagaccatctattctctgaacttcctaagtggtcgggttggtcgtggcgctcatagttagcccagaacgtccagtttatgtggtggtgatcttggttgccagactcagtatggtcaaaatagttgtgctcgccatttcaactagtgcagttgctaaagtgccaactaaggttcgtcttgaagcaatcggtagtatctgcagtcaagtcgtagtcgtaggtatggcacttgtcgtgcgtctaggacgcgttgaagctatcttattgcccgaag

SEQ ID NO: 205 - DNA, 640 bp, Artificial Sequence
  exon
attgtaagtttaatttaccatttcgtcattgtatatgcggtaaacgtaaatttacacatatgacacgaactttgagttttattagcctgcctaattgttggtaacaatgtaatggaaattggcgatgactatggggaaagagcaatcaactcaccataaatttgtgaacgcagttaagtaattggcatcgcgcgcctaatcgtttacattcgcatggaacaagaagaaagagacctattcgtgggagtcaatggctatgtggaaaaacatgaactgccaaattcggctaaccaaccagaaatggtcatggaaaattcttgcgtcaaagttcgcggtgacgtttacgaagaagctaaacttgtgcttgtttagaaagttaggtgcgtcctggttttagtaaatttagaaaaccattttgttgtttgcgacagttaaataaaacttaacgacaaagaagtgacttgcgtcgtagattaactggaaattaaagtggtatctaaaatggggtttgccgatgcggtcttcaaagtctaaaattcttgaagtttgcgtttggtcgcaaaaattatggatttagtcgattattgcctactaagcagcagtttagaagtttttaagatagttacgctagaagaccggg

SEQ ID NO: 206 - DNA, 630 bp, Artificial Sequence
  exon
attgtaagtttaatttaccatttcgtcattgtatatgcggtaaacgtaaatttacacatatgacacgaactttgagttttattagcctgcctaattgttggtaacaatgtaatggaaattggcgatgactatggggaaagagcaatcaactcaccataaatttgtgaacgcagttaagtaattggcatcgcgcgcctaatcgtttacattcgcatggaacaagaagaaagagacctattcgtgggagtcaatggctatgtggaaaaacatgaactgccaaattcggctaaccaaccagaaatggtcatggaaaattcttgcgtcaaagttcgcggtgacgtttacgaagaagctaaacttgtgcttgtttagaaagttaggtgcgtcctggttttagtaaatttagaaaaccattttgttgtttgcgacagttaaataaaacttaacgacaaagaagtgacttgcgtcgtagattaactggaaattaaagtggtatctaaaatggggtttgccgatgcggtcttcaaagtctaaaattcttgaagtttgcgtttggtcgcaaaaattatggatttagtcgattattgcctactaagcagcagtttagaagtttttaagatagttacgcta

SEQ ID NO: 207 - DNA, 628 bp, Artificial Sequence
  exon
attgtaagtttaatttaccatttcgtcattgtatatgcggtaaacgtaaatttacacatatgacacgaactttgagttttattagcctgcctaattgttggtaacaatgtaatggaaattggcgatgactatggggaaagagcaatcaactcaccataaatttgtgaacgcagttaagtaattggcatcgcgcgcctaatcgtttacattcgcatggaacaagaagaaagagacctattcgtgggagtcaatggctatgtggaaaaacatgaactgccaaattcggctaaccaaccagaaatggtcatggaaaattcttgcgtcaaagttcgcggtgacgtttacgaagaagctaaacttgtgcttgtttagaaagttaggtgcgtcctggttttagtaaatttagaaaaccattttgttgtttgcgacagttaaataaaacttaacgacaaagaagtgacttgcgtcgtagattaactggaaattaaagtggtatctaaaatggggtttgccgatgcggtcttcaaagtctaaaattcttgaagtttgcgtttggtcgcaaaaattatggatttagtcgattattgcctactaagcagcagtttagaagtttttaagatagttacgc

SEQ ID NO: 208 - DNA, 493 bp, Artificial Sequence
  exon
attgtaagtttaatttaccatttcgtcattgtatatgcggtaaacgtaaatttacacatatgacacgaactttgagttttattagcctgcctaattgttggtaacaatgtaatggaaattggcgatgactatggggaaagagcaatcaactcaccataaatttgtgaacgcagttaagtaattggcatcgcgcgcctaatcgtttacattcgcatggaacaagaagaaagagacctattcgtgggagtcaatggctatgtggaaaaacatgaactgccaaattcggctaaccaaccagaaatggtcatggaaaattcttgcgtcaaagttcgcggtgacgtttacgaagaagctaaacttgtgcttgtttagaaagttaggtgcgtcctggttttagtaaatttagaaaaccattttgttgtttgcgacagttaaataaaacttaacgacaaagaagtgacttgcgtcgtagattaactggaaattaaagtgg

SEQ ID NO: 209 - DNA, 133 bp, Artificial Sequence
  exon
attgtaagtttaatttaccatttcgtcattgtatatgcggtaaacgtaaatttacacatatgacacgaactttgagttttattagcctgcctaattgttggtaacaatgtaatggaaattggcgatgactatg

SEQ ID NO: 210 - DNA, 82 bp, Artificial Sequence
  exon
attgtaagtttaatttaccatttcgtcattgtatatgcggtaaacgtaaatttacacatatgacacgaactttgagttttat

SEQ ID NO: 211 - DNA, 276 bp, Artificial Sequence
  exon
gctctcatgtagcctaccttacgaagaaatcgcacaagtcggtcgcccagcggtggcatatgtcttgcctaacgtttctagaccgatcagcctcacgagtagcctgcttgtggtgtttatagtttacgctagtccaatctgtatcgtgccgcttggtatggctattgtcggcctggatgcaagcactaacgtggtcatcagactggtctgcgctataatctacgcaatagaggcaccagcggtcgttgaagccgaagacgctatttcggtggcttg

SEQ ID NO: 212 - DNA, 182 bp, Artificial Sequence
  exon
gctctcatgtagcctaccttacgaagaaatcgcacaagtcggtcgcccagcggtggcatatgtcttgcctaacgtttctagaccgatcagcctcacgagtagcctgcttgtggtgtttatagtttacgctagtccaatctgtatcgtgccgcttggtatggctattgtcggcctggatgcaa

SEQ ID NO: 213 - DNA, 300 bp, Artificial Sequence
  exon
aagaagcgaaacggcattcgtttaacaaaacgtcacatatttaggtatagtagattgcgttcacaaagaaatttaaagtcttgtaattatggtggtcgatttattggtagtatatttggaaatagcatgcaattttggaatggacgaagaacctgacatctgagctattgtaagtttaatttaccatttcgtcattgtatatgcggtaaacgtaaatttacacatatgacacgaactttgagttttattagcctgcctaattgttggtaacaatgtaatggaaattggcgatgactatgg

SEQ ID NO: 214 - DNA, 77 bp, Artificial Sequence
  exon
aagaagcgaaacggcattcgtttaacaaaacgtcacatatttaggtatagtagattgcgttcacaaagaaatttaaa

SEQ ID NO: 215 - DNA, 84 bp, Artificial Sequence
  exon
aaataagaagaagcgaaacggcattcgtttaacaaaacgtcacatatttaggtatagtagattgcgttcacaaagaaatttaaa

SEQ ID NO: 216 - DNA, 132 bp, Artificial Sequence
  exon
gaacttaaattgttagagcagtttatgggtggtaggttacatctatttacttcaaaacgcggtgccctagcccacaagcattgctttgtaaaattgttgaaggtaacttgtaaaagccgaacatgaacgatg

SEQ ID NO: 217 - DNA, 66 bp, Artificial Sequence
  exon
gtatatgtactttggtaacgctctaaggtaggtacacgttagtgatataaaaagaaggcgacgacg

SEQ ID NO: 218 - DNA, 104 bp, Artificial Sequence
  exon
agattgcagagagccaggtcaaatacattgagaaatctgtatatgtactttggtaacgctctaaggtaggtacacgttagtgatataaaaagaaggcgacgacg

SEQ ID NO: 219 - DNA, 384 bp, Artificial Sequence
  exon
gtcacctaaacgtgcgaagtgtgcgaaattaccaccgtaaattcgtcctactgaaagtgcttacgcatcttgagagagattgcagagagccaggtcaaatacattgagaaatctgtatatgtactttggtaacgctctaaggtaggtacacgttagtgatataaaaagaaggcgacgacggtagcagaggtctagaaaccgcatgaacgaccaacttatttgaagagctagtgcggtggaattgggtcggaagaacttaaattgttagagcagtttatgggtggtaggttacatctatttacttcaaaacgcggtgccctagcccacaagcattgctttgtaaaattgttgaaggtaacttgtaaaagccgaacatgaacgatg

SEQ ID NO: 220 - DNA, 511 bp, Artificial Sequence
  exon
gatgtggaaggtcacagcctcgttggaggagatactacggtcccgcttttcgtgggtgacaaaggtcgcaaaggtttccttagggaggtcgtttcccggatctttatctacatctcctgggtgaaggggatgatctttctctacatgtcctgggtggaggggagtttccttgtatgggtggaacccaacccgccggtgagggtgagttacggtcggcggtcatatgtgggtatgacgggtatgacgtcataaatagtcgttgtcaaaatgggaggtggaagtccttactgtagtcacccgtgaaggtggagaactggcaggacatctctaggtcacctaaacgtgcgaagtgtgcgaaattaccaccgtaaattcgtcctactgaaagtgcttacgcatcttgagagagattgcagagagccaggtcaaatacattgagaaatctgtatatgtactttggtaacgctctaaggtaggtacacgttagtgatataaaaagaaggcgacgacg

SEQ ID NO: 221 - DNA, 146 bp, Artificial Sequence
  exon
gatgtggaaggtcacagcctcgttggaggagatactacggtcccgcttttcgtgggtgacaaaggtcgcaaaggtttccttagggaggtcgtttcccggatctttatctacatctcctgggtgaaggggatgatctttctctacat

SEQ ID NO: 222 - DNA, 81 bp, Artificial Sequence
  exon
gagaagatgacaaagtagaagctagacaactatatcaaatcgttgtgtggtcttaaaccgacacagtagcattcatcgttg

SEQ ID NO: 223 - DNA, 163 bp, Artificial Sequence
  exon
gagaaacttgtctactggcagacctcactatcttttaggaaggtcacgaagcggctggagtgatggctagtctcagccactgtcaacgggaagcgcgacgtttatggtcaatataaactagcagtttaatccgtatggcgatcttagcggatgttacaggatg

SEQ ID NO: 224 - DNA, 131 bp, Artificial Sequence
  exon
gagtgttgtattaattcactctagagtaatggatcacggtgccagaaactaaggtggtgtaggactagatgcaagtaacaacggtcgtactaaaatcagctacgcgatcgccgacttagaaggctgagatg

SEQ ID NO: 225 - DNA, 64 bp, Artificial Sequence
  exon
gatgtgaaaatgtcatatgtgcggcaaaaatagacgacatttaagaacctagcattataggatg

SEQ ID NO: 226 - DNA, 125 bp, Artificial Sequence
  exon
gaacacagatattgcagaagcgggaatgaggttgatattacatcaagtatcaacagacgacctcagaagggtggtcttttaaaatgacaacgtacattaagatgcagacaaacactactatgctg

SEQ ID NO: 227 - DNA, 58 bp, Artificial Sequence
  exon
gattacgacgccaagccactataaatgctaattgagtcgaagaaggtactcctttttg

SEQ ID NO: 228 - DNA, 83 bp, Artificial Sequence
  exon
gatctaagatgactacagtagcatagccatagaacatggcactgaaatatcgatgggcgtaaaagtgaacaacgcagacgatg

SEQ ID NO: 229 - DNA, 70 bp, Artificial Sequence
  exon
gaaatcgcatcgacacaataaaagtacaccaaccagcagaaaacaggtacatatacagtttaacgacctg

SEQ ID NO: 230 - DNA, 160 bp, Artificial Sequence
  exon
gaaccaagcagtgggcgatgtcagcgacaattccactttggtagaggtcgttcttttgtagaaaacaatctaacataactatgacactttcggtaaattcaccacctttaccagggtcgtaagtggtcaagccacgccgaccacttcataagcattggtg

SEQ ID NO: 231 - DNA, 115 bp, Artificial Sequence
  exon
gaaccaagcagtgggcgatgtcagcgacaattccactttggtagaggtcgttcttttgtagaaaacaatctaacataactatgacactttcggtaaattcaccacctttaccagg

SEQ ID NO: 232 - DNA, 106 bp, Artificial Sequence
  exon
gatcgtttgcccgtaaaactaactggcaaaagcctaagtgctgtttcgggtgcaatggtataacttcccacatttagccgaatagcgccaacagcgttattatttg

SEQ ID NO: 233 - DNA, 93 bp, Artificial Sequence
  exon
gtagacctttccttgccgcgtggaacaaaccgccatgagtgttttacgtttacggtcggcgaccggagtcacagcgcgaccaacggggccagg

SEQ ID NO: 234 - DNA, 121 bp, Artificial Sequence
  exon
gcccatgaattacccgcttaggcaatgggtagacctttccttgccgcgtggaacaaaccgccatgagtgttttacgtttacggtcggcgaccggagtcacagcgcgaccaacggggccagg

SEQ ID NO: 235 - DNA, 122 bp, Artificial Sequence
  exon
ggcccatgaattacccgcttaggcaatgggtagacctttccttgccgcgtggaacaaaccgccatgagtgttttacgtttacggtcggcgaccggagtcacagcgcgaccaacggggccagg

SEQ ID NO: 236 - DNA, 130 bp, Artificial Sequence
  exon
gacttgtaggcccatgaattacccgcttaggcaatgggtagacctttccttgccgcgtggaacaaaccgccatgagtgttttacgtttacggtcggcgaccggagtcacagcgcgaccaacggggccagg

SEQ ID NO: 237 - DNA, 141 bp, Artificial Sequence
  exon
gcatactgcaagacttgtaggcccatgaattacccgcttaggcaatgggtagacctttccttgccgcgtggaacaaaccgccatgagtgttttacgtttacggtcggcgaccggagtcacagcgcgaccaacggggccagg

SEQ ID NO: 238 - DNA, 135 bp, Artificial Sequence
  exon
gcatactgcaagacttgtaggcccatgaattacccgcttaggcaatgggtagacctttccttgccgcgtggaacaaaccgccatgagtgttttacgtttacggtcggcgaccggagtcacagcgcgaccaacggg

SEQ ID NO: 239 - DNA, 218 bp, Artificial Sequence
  exon
gagcgttagtcggcgcgtgcgcgggactatttagcgaaggtcgccgtatcgcgggtggcggcgtttccgccataacaacaagcgtttaaggtcagagtccgcgacgaatgaaacgccgtgcaagcggctttggtacggccagtttagccaaagcctgatccgttcgccttgggttatcatgtaccagtcaagcggtcatcgcgggcggcgttatcatg

SEQ ID NO: 240 - DNA, 51 bp, Artificial Sequence
  exon
gagcgttagtcggcgcgtgcgcgggactatttagcgaaggtcgccgtatcg

SEQ ID NO: 241 - DNA, 229 bp, Artificial Sequence
  exon
actttccagttagtcgccgtcctatattggcaagaccggatggccgtcaaccagttccattctgactatttgccacattgattaaagaagtaggagcgttagtcggcgcgtgcgcgggactatttagcgaaggtcgccgtatcgcgggtggcggcgtttccgccataacaacaagcgtttaaggtcagagtccgcgacgaatgaaacgccgtgcaagcggctttggtac

SEQ ID NO: 242 - DNA, 202 bp, Artificial Sequence
  exon
gtgttaggtgcaatccccattcgggacggacacgcgagtaaaggtctaacatgtttcaactttccagttagtcgccgtcctatattggcaagaccggatggccgtcaaccagttccattctgactatttgccacattgattaaagaagtaggagcgttagtcggcgcgtgcgcgggactatttagcgaaggtcgccgtatcg

SEQ ID NO: 243 - DNA, 38 bp, Artificial Sequence
  exon
gtgttaggtgcaatccccattcgggacggacacgcgag

SEQ ID NO: 244 - DNA, 412 bp, Artificial Sequence
  exon
gcaaaggcccataggcttttccatcggcacgcgaccgattccatcaagtatagccacggtcgtaacttcgacggcggcaatagtttatggcgctaacacctttccatcgctgagtccaaacgtatgacgtgaggtgttaggtgcaatccccattcgggacggacacgcgagtaaaggtctaacatgtttcaactttccagttagtcgccgtcctatattggcaagaccggatggccgtcaaccagttccattctgactatttgccacattgattaaagaagtaggagcgttagtcggcgcgtgcgcgggactatttagcgaaggtcgccgtatcgcgggtggcggcgtttccgccataacaacaagcgtttaaggtcagagtccgcgacgaatgaaacgccgtgcaagcggc

SEQ ID NO: 245 - DNA, 417 bp, Artificial Sequence
  exon
ccagagcaaaggcccataggcttttccatcggcacgcgaccgattccatcaagtatagccacggtcgtaacttcgacggcggcaatagtttatggcgctaacacctttccatcgctgagtccaaacgtatgacgtgaggtgttaggtgcaatccccattcgggacggacacgcgagtaaaggtctaacatgtttcaactttccagttagtcgccgtcctatattggcaagaccggatggccgtcaaccagttccattctgactatttgccacattgattaaagaagtaggagcgttagtcggcgcgtgcgcgggactatttagcgaaggtcgccgtatcgcgggtggcggcgtttccgccataacaacaagcgtttaaggtcagagtccgcgacgaatgaaacgccgtgcaagcggc

SEQ ID NO: 246 - DNA, 54 bp, Artificial Sequence
  exon
ccagagcaaaggcccataggcttttccatcggcacgcgaccgattccatcaagt

SEQ ID NO: 247 - DNA, 110 bp, Artificial Sequence
  exon
gaggaagccttttagccatcgctatgccgccgctcaaacgcgccgggtgcaaaagcccagagcaaaggcccataggcttttccatcggcacgcgaccgattccatcaagt

SEQ ID NO: 248 - DNA, 557 bp, Artificial Sequence
  exon
agctgctcgcatgaccagctatatctggaacatcgctggtgggtcttatggtcgcttttgtgggaaccatcatagtcgcaagtctggccttcggtatggaactcgtcgtcccgactacaaccatagctagtctcggtctcggctttgttgcaatgcccttcgttactacttcaacggtcgtggtgccggtcaaaccgctcgctaaagcaagcgaagaaacagctaaacttagttgtgtcgaaacatcctaagtggtcgggttgctcgtggagcatgcagctagcccagaacctttagcttgtgtggtcttcgtctcggtagtcagaaccaggtcggtctgaatggttggactcgccacatcaactaggtcagctattgaagtgccaactaaaggtcgtattgaagcaatcggtcctatggcaagtcaagtgacagtcgtaggtatggcacttgccgcgcctccagaactcggtcaagctacctcataactcggaagtcgactgctctaaagcgaagttgtcaaacgaacagctatgccttcgagtaaagcaaggtgc

SEQ ID NO: 249 - DNA, 2473 bp, Artificial Sequence; identical to SEQ ID NO: 114
  exon

SEQ ID NO: 250 - DNA, 734 bp, Artificial Sequence
  exon
gtccacgctctaagtcgcttgcccaattgtggctaccgcattgctcagaacttcgggtactggccaaccttcaagaagcctagtcttggtgcgtcaccccagtcacgtagcatacccgtcatcatctatggtcgtaggtccaacaatcgtggcgccattgggtaccacttcatcagagctgctcgcatgaccagctatatctggaacatcgctggtgggtcttatggtcgcttttgtgggaaccatcatagtcgcaagtctggccttcggtatggaactcgtcgtcccgactacaaccatagctagtctcggtctcggctttgttgcaatgcccttcgttactacttcaacggtcgtggtgccggtcaaaccgctcgctaaagcaagcgaagaaacagctaaacttagttgtgtcgaaacatcctaagtggtcgggttgctcgtggagcatgcagctagcccagaacctttagcttgtgtggtcttcgtctcggtagtcagaaccaggtcggtctgaatggttggactcgccacatcaactaggtcagctattgaagtgccaactaaaggtcgtattgaagcaatcggtcctatggcaagtcaagtgacagtcgtaggtatggcacttgccgcgcctccagaactcggtcaagctacctcataactcggaagtcgactgctctaaagcgaagttgtcaaacgaacagctatgccttcgagtaaagcaaggtgcg

SEQ ID NO: 251 - DNA, 133 bp, Artificial Sequence
  exon
gatagtagaccgggaagaccaacgttttttcactactccgaaagaacacactgaagggaacggtgtaggttcggtgagtccgggactaggtgtccatgtcggagacctcagtggtgacgtcctcgtagtatag

SEQ ID NO: 252 - DNA, 132 bp, Artificial Sequence
  exon
gatagtagaccgggaagaccaacgttttttcactactccgaaagaacacactgaagggaacggtgtaggttcggtgagtccgggactaggtgtccatgtcggagacctcagtggtgacgtcctcgtagtata

SEQ ID NO: 253 - DNA, 50 bp, Artificial Sequence
  exon
caaacgatgtcttgaacaacaccgtcttcattgtttaccatttgctgttg

SEQ ID NO: 254 - DNA, 49 bp, Artificial Sequence
  exon
caaacgatgtcttgaacaacaccgtcttcattgtttaccatttgctgtt

SEQ ID NO: 255 - DNA, 31 bp, Artificial Sequence
  exon
gcaattaggatcaggtggttaatctgatacg

SEQ ID NO: 256 - DNA, 118 bp, Artificial Sequence
  exon
ggaggacatgcacctagttgaacacgactaggaggacgatggccactacggagtggaacacaaaggtaaagttgcaataataaccagtacaacaaaagcatacgtggaaggtgacaag

SEQ ID NO: 257 - DNA, 361 bp, Artificial Sequence
  exon
gaatgtatgtaattattcgcaagggttccataaggcacatatacaaatttagaaacaacccgttacattaacaaaggtgaacggtgtttcacagatattagaccattaggtaaccaatgacatttcactatcgaaaagggtatagtattaactactacaactaatccgactcgtcgaggtgatttatacaggactgcaggtagcaaacgacgaggtggacgagggtaaggtggccgacgaaagggaggacatgcacctagttgaacacgactaggaggacgatggccactacggagtggaacacaaaggtaaagttgcaataataaccagtacaacaaaagcatacgtggaaggtgacaag

SEQ ID NO: 258 - DNA, 145 bp, Artificial Sequence
  exon
gaatgtatgtaattattcgcaagggttccataaggcacatatacaaatttagaaacaacccgttacattaacaaaggtgaacggtgtttcacagatattagaccattaggtaaccaatgacatttcactatcgaaaagggtatag

SEQ ID NO: 259 - DNA, 110 bp, Artificial Sequence
  exon
gtgaaaggtgatacatatttacttgacttcttaagcagagagcgtcaaaacaggttgaacttatacagaaatactaaaagtcgaacaaccattcgatttaggaatacaga

SEQ ID NO: 260 - DNA, 151 bp, Artificial Sequence
  exon
gatacagaacaactaaaagaactaaaagagaagaacgacgtgcacgtgctaattatgcgaattaacatcgggttagaaaaagtaaactaaaggaaaatgggtaaggcatatgccttactaaattgtgtaaaagaagttctaataagaaccg

SEQ ID NO: 261 - DNA, 156 bp, Artificial Sequence
  exon
gtgcagatacagaacaactaaaagaactaaaagagaagaacgacgtgcacgtgctaattatgcgaattaacatcgggttagaaaaagtaaactaaaggaaaatgggtaaggcatatgccttactaaattgtgtaaaagaagttctaataagaaccg

SEQ ID NO: 262 - DNA, 346 bp, Artificial Sequence
  exon
caccaccggagggttgctagaccctaacgtgggagacgctctatccacagctacatcattcagaagagaaagaagagggtcttctacaggggacattgcagctaacacgctggttgttcgttgcgtagacgacacttgttctgtcgctaccgaggcaagtaaagtcgccaacgtagtatcgccaatggtaacagtagcaatctgtcattcaccacgcgaactggactatgtttaaatccctttgccaatcttccctattgtcccgtcaacttccttctgtcttgctttggtaagtgtcaacgtggcctgaccgaatatcacattcagaacagttgctatgctacac

SEQ ID NO: 263 - DNA, 265 bp, Artificial Sequence
  exon
gccaaggtgaaccaggacgaagtcgatgtttcagaacctcctttaggccttttagacggtttaaacgaagcactagaccaagtaataaaagcggacgttgcacaggtacgtgcagatacagaacaactaaaagaactaaaagagaagaacgacgtgcacgtgctaattatgcgaattaacatcgggttagaaaaagtaaactaaaggaaaatgggtaaggcatatgccttactaaattgtgtaaaagaagttctaataagaaccg

SEQ ID NO: 264 - DNA, 430 bp, Artificial Sequence
  exon
ctagcgcgtccgtcaacttcacactggttccgtagtcctaacgttgtagtctgtgcagatgaagaacgaggtcaacaacgaggtcacgtatgagataccgtcggtagtccatgacacccgaaaggtcacgtcaactaagcaattgaagttgcaattacctcttcggtactggaaattgggcacccaaccaagcgaaccgaaaccacactcgttacggtggctcgtcgttgacgacctgctggtaaagcagaaggtacgcgaagttaacgaaccagaccaagtatcggtcgaatccgaattgtcttagttacagtgggacttgcagtacgacgtatcgttgccacaatgcccgttattgtcaccacagctaatggtgaaccaagaacagccagactcatggtcaacgtaatccactgactgggccacgatc

SEQ ID NO: 265 - DNA, 208 bp, Artificial Sequence
  exon
ctagcgcgtccgtcaacttcacactggttccgtagtcctaacgttgtagtctgtgcagatgaagaacgaggtcaacaacgaggtcacgtatgagataccgtcggtagtccatgacacccgaaaggtcacgtcaactaagcaattgaagttgcaattacctcttcggtactggaaattgggcacccaaccaagcgaaccgaaaccacac

SEQ ID NO: 266 - DNA, 520 bp, Artificial Sequence
  exon
gacggttaaagttattgacttatgttagcatgtgcaaattaacataggctagtcttaacctgactcgctgtcgcgactggcatgcaaagtttgacacgccgcggctctagtacgcgtcatctttcagctgtaataactacaaacacatcaaaaaaagtcggtttaaaacaacttgtgaaacgtcaacttggtaaataaacctattattaaagaatctagatcaatgtccaaaaagattatttccattgttacgtctaaatacagattctgcgaaaacaagccattagtatagtagaagaactaaccatcgtatgttcgtgaacgtcgagtcaaagtggctacatgaacaacgattgccacaagcatggtcagtgtcagacttctagcttcatcgggtcgtctaagagtggaaagtccatgacgagcaattggaatggcaatttgaagaggtactcttccgacagttggagtggtctccgcctttgccgttgtaaccaatccaataaaccgcatctgtaaa

SEQ ID NO: 267 - DNA, 1019 bp, Artificial Sequence
  exon
cctgtttctagcatgtataacaaaattaagcgacgaccgagcgacgacaacaagcagcagccaggtgggcaaaaggctaagactgctttgatgtcctgagccaacttgccgatacgcagcaacattttagaaacgtcatcctgaccgccgccgccattgccataaatgatagcttggcggtagccgcccaaaactatgaaaaaaattaaattaaggaaagacataaacaaggtagttaagccatgcacctagaaaattttgaacggctcagctgcaacatattagcgctagaaatgacctaccataatgatatagaagataattaccattactgccaccgcctcctccgctgccgcctcctccatagcagcttctattcaaacaaactccgccgccgccaccgccgccataaccaccaccataaccaccgccgtatacacaaacgccgctccttctaagtcttagctattaataacaaccgtggaaacaaaaaacgtaatataggctacagctgtgtcaacagccaaatccataacaacaaaatccatggtgactgtaacagacactgttacaaccatattattaactagatagtggttacagataatcatgcagcaacaacatataaagaagacggttaaagttattgacttatgttagcatgtgcaaattaacataggctagtcttaacctgactcgctgtcgcgactggcatgcaaagtttgacacgccgcggctctagtacgcgtcatctttcagctgtaataactacaaacacatcaaaaaaagtcggtttaaaacaacttgtgaaacgtcaacttggtaaataaacctattattaaagaatctagatcaatgtccaaaaagattatttccattgttacgtctaaatacagattctgcgaaaacaagccattagtatagtagaagaactaaccatcgtatgttcgtgaacgtcgagtcaaagtggctacatgaacaacgattgccacaagcatggtcagtgtcagacttctagc

SEQ ID NO: 268 - DNA, 468 bp, Artificial Sequence
  exon
cttgttccaatcggcccggcttcagtcattcccggtggcgaagccatgtcaccaataaaaactatcggcggcaatggaagtggtttttcggaaactgttacgggtgcaagcggccccagtgcagtttgtgccttgccaatcggcccagctttcaaacgcaaagttggacgacttattggcccattctgacaacgtcctgttaaactgcccggacgttcaaacggcggtatcggacgactaacgcgttacggcggacaactcgcccccagtcaacaacttggacacggtaaatttgaacgctaagtcaactgtagcagttaaacattgagtattaaaatagatttaagctagcgttaagaacattaaaaactaaccagccaaaccaaggattacggctgtggtgtaatcgattgcgaaatagcatgacaaaaaacttacagtttagaaggtggcggtattacttaagaa

SEQ ID NO: 269 - DNA, 151 bp, Artificial Sequence
  exon
gacatcagatgttaatgacctaacgattatagtgctgaacaacgtctacgacaatataaacctttgcaaagactggtcaaacatcaatgttaaacacgtccagataaaagcaaaaaggtaagacgaggattacggaataattaatatagtg

SEQ ID NO: 270 - DNA, 247 bp, Artificial Sequence
  exon
gaaacaagctatgctaatgttgaccatttggctcttcgaccagcagtcagccgcttctttacctgccaacgttgttcataacaggcaaaaccagaaagtcgcataggttggtcaactttcgcagaaccaactgttactgcgatcttcagcttgccttttgtcccagattaacgtgtaattattaaacaaagttcggcagttccagtcgctatcgacaaaaccgaaaccacaagttctgtaattacgc

SEQ ID NO: 271 - DNA, 509 bp, Artificial Sequence
  exon
cattcgttcaacatgaagtggcttatgttcgcggagtagtagcgcgtaaaagtgtaggtacgcgagctatcgtgcggtgtagcatcgcagtcaaagcttgcgtaggtagcgttgcaatctcctgtactaaagacatgcaactgccagcttgtactgttggcgaagaaagttcagtggatgttactaaccgcgtttaacgcgtggacacggcggcagttgagccaatcgattacgaaacaagctatgctaatgttgaccatttggctcttcgaccagcagtcagccgcttctttacctgccaacgttgttcataacaggcaaaaccagaaagtcgcataggttggtcaactttcgcagaaccaactgttactgcgatcttcagcttgccttttgtcccagattaacgtgtaattattaaacaaagttcggcagttccagtcgctatcgacaaaaccgaaaccacaagttctgtaattacgcgttcggcaaagcgcaatgcgccctaatac

SEQ ID NO: 272 - DNA, 135 bp, Artificial Sequence
  exon
gtggttaggtcgcttggtagcatatctgttaccgaagacacgacagtaaattgtcaagcaaacactgcgccttcttcggtcgcataaagaagtgaaccataacgttctcctacttaactccgcaacgaaaaagag

SEQ ID NO: 273 - DNA, 110 bp, Artificial Sequence
  exon
gtggttaggtcgcttggtagcatatctgttaccgaagacacgacagtaaattgtcaagcaaacactgcgccttcttcggtcgcataaagaagtgaaccataacgttctcc

SEQ ID NO: 274 - DNA, 178 bp, Artificial Sequence
  exon
acatttgattcgttgacgtatttatgttgattcggttagcgagagttacaaagttagtaatagaaagaaagaggaaataataatcaaaagattaagcatgcaaacattaagaggacacatatgtattggtggcatttgcgttaggttaacgtctcgtaagacggtgaagctgcttaaa

SEQ ID NO: 275 - DNA, 216 bp, Artificial Sequence
  exon
ttacgatccgaaatttcatggacacagatatttgagatcaacatttgattcgttgacgtatttatgttgattcggttagcgagagttacaaagttagtaatagaaagaaagaggaaataataatcaaaagattaagcatgcaaacattaagaggacacatatgtattggtggcatttgcgttaggttaacgtctcgtaagacggtgaagctgctta

SEQ ID NO: 276 - DNA, 185 bp, Artificial Sequence
  exon
gattacgatccgaaatttcatggacacagatatttgagatcaacatttgattcgttgacgtatttatgttgattcggttagcgagagttacaaagttagtaatagaaagaaagaggaaataataatcaaaagattaagcatgcaaacattaagaggacacatatgtattggtggcatttgcgtta

SEQ ID NO: 277 - DNA, 182 bp, Artificial Sequence
  exon
gattacgatccgaaatttcatggacacagatatttgagatcaacatttgattcgttgacgtatttatgttgattcggttagcgagagttacaaagttagtaatagaaagaaagaggaaataataatcaaaagattaagcatgcaaacattaagaggacacatatgtattggtggcatttgcg

SEQ ID NO: 278 - DNA, 92 bp, Artificial Sequence
  exon
aaagaagatgcacttagtgccattattattagacaagatagtccgttctttagtcgaagttcttgttgtaataacaaaagtagagcagtatt

SEQ ID NO: 279 - DNA, 232 bp, Artificial Sequence
  exon
gtttcaacaatgcccaagttgacattattccaaaacgtttcgtagaaatgaaagcgcttcgagtaattaggcgcaaacttacaggacgccatggcatatgggtggtagaaccaacgatggaagcgagtagcgcaatgccttagcgcacgcctacactaactgcttacgaagttggagcaaaagaaactgaacgtgtcagccaaaattgccaagaaacaggagctaccaaaag

SEQ ID NO: 280 - DNA, 116 bp, Artificial Sequence
  exon
catcgtacgaactttgacaacgaaaggttcaaaggtaaccaaggcgtagtagtgagttaggtcaatgtataaaaactccctttcttattttgagtcgtcaatgtagtcgagaaagt

SEQ ID NO: 281 - DNA, 96 bp, Artificial Sequence
  exon
tattgttataggcggtatattggtaaatgacgatccttgacttagttttttacatcgaacggttgcaaatcctagcatacttgatattaatagtag

SEQ ID NO: 282 - DNA, 2235 bp, Artificial Sequence
  exon
gagtaaacgaacatccaacagtatgtacaatcgtatgagaaaggacaaatctgaagacgatattagagggagtccaacaagtttgtgatgattcacgtaaggaaatcgaaatgtaagattattcgtcaatggaggtataagacaacacaccaagtaattatacgcgacgagttttcatgttgacgatccctgagactatatcatacaaaattgacccaaataataaactcgttccaatagttgaagtgttgattaacacattgagacaagttgtccgtactttaatcatcaaagttttggactgacctataaatgaaatattcgcgttgtcttcagtttaagaagtgatattattttcggtttcaagcctatgtggagagatacaggaaataggtaaactataactaatataaatatacgcagacgaagcctgttaactttaccaaatccaaatagcgggagacactaaacttacaagaaatgtacggtaagacagggaaacagggtttgaagtttggaggtacaaaatcttaatccttcacaactgaatcaacatttacattcggttacgttcggggtttgtagtagtaattgttgaggtaattttaattgcacttacagacgtggatttggtgaaacattatgtggtagattcatatttccgaatcttaatagacgattttatgatggtgatcgtggtttcttttcaaggtttggtggacgaaaatgaaaaaatcacaatttaacgtttcatattcatcacaatccgaaatcgagatggagagaaagtttgactaaactttgttacagtatttttgaaggcaatcaacctggaactttggatttcatcaagtaaacacccatatttagcgaaaatgcaagctaactgcgaactaacaaggtaactctttttcgatttcaaaatatggtcagtagcaatatgttaagtgatccattttggaggggtggggatttgttcaatgaatgaggcaataaaccaccgcaacctctgtaattgacgagaaacttgtataaggtcatcaaaaagaatagatgaacataaagattgaatacggctgggtgaggttaattcagatttcccaaattatgtagatgaaaagatggtaagtttattgataggtaaaaaatcaagagagggtaataaagaagaaagaataatcaaaagatagagcatgcaaacattacatggtagtattgttataggcggtatattggtaaatgacgatccttgacttagttttttacatcgaacggttgcaaatcctagcatacttgatattaatagtagatactgaaatatatctgagtatatcaagggaaatcgagatgtaacaataagtcgaggaaattaaggtcaatttagtgcttatcatagaaataactacttaagcccttaacgaactaactcaaattaacgaggtagaggttattctgaattgtacgaacgtagtcgaagtttgttaccaagggtaaagccaaaacaaaacgatttgacaagagaatctattccatgtagtagtgcgtttgtacgacgttctattcgatgtaaatcattaggacgagggtttgaagcaactcggaaagatggtcggttagaatttaaaagtactgaacggaattaacgaagttggctactacctaatagtctttgcttaggatttagtagttcgcaattgggtcaaagtggtcgctttggtcgtcgacgtcaagactcaacaagtcatttaccgctgtacgaaccatctcatttaacaggttctcaaccaaatagcggtaggagtagaaagcacttaccatcgtacgaactttgacaacgaaaggttcaaaggtaaccaaggcgtagtagtgagttaggtcaatgtataaaaactccctttcttattttgagtcgtcaatgtagtcgagaaagtgtccaagcaaaacgtaacgaaacggttgagtaaggacttgcacactatgcccttgcgggtttacctgcttgacgtagtcctgccacttattatccgtgattgttacctaatggacaacctaatcgttagcttaaagaagatgcacttagtgccattattattagacaagatagtccgttctttagtcgaagttcttgttgtaataacaaaagtagagcagtattttgacgtatagggagacagtcattaggtcattaacccagttactaaggacaacgtaaccatcgaagttattgaacttcag

SEQ ID NO: 283 - DNA, 1765 bp, Artificial Sequence
  exon
gagtaaacgaacatccaacagtatgtacaatcgtatgagaaaggacaaatctgaagacgatattagagggagtccaacaagtttgtgatgattcacgtaaggaaatcgaaatgtaagattattcgtcaatggaggtataagacaacacaccaagtaattatacgcgacgagttttcatgttgacgatccctgagactatatcatacaaaattgacccaaataataaactcgttccaatagttgaagtgttgattaacacattgagacaagttgtccgtactttaatcatcaaagttttggactgacctataaatgaaatattcgcgttgtcttcagtttaagaagtgatattattttcggtttcaagcctatgtggagagatacaggaaataggtaaactataactaatataaatatacgcagacgaagcctgttaactttaccaaatccaaatagcgggagacactaaacttacaagaaatgtacggtaagacagggaaacagggtttgaagtttggaggtacaaaatcttaatccttcacaactgaatcaacatttacattcggttacgttcggggtttgtagtagtaattgttgaggtaattttaattgcacttacagacgtggatttggtgaaacattatgtggtagattcatatttccgaatcttaatagacgattttatgatggtgatcgtggtttcttttcaaggtttggtggacgaaaatgaaaaaatcacaatttaacgtttcatattcatcacaatccgaaatcgagatggagagaaagtttgactaaactttgttacagtatttttgaaggcaatcaacctggaactttggatttcatcaagtaaacacccatatttagcgaaaatgcaagctaactgcgaactaacaaggtaactctttttcgatttcaaaatatggtcagtagcaatatgttaagtgatccattttggaggggtggggatttgttcaatgaatgaggcaataaaccaccgcaacctctgtaattgacgagaaacttgtataaggtcatcaaaaagaatagatgaacataaagattgaatacggctgggtgaggttaattcagatttcccaaattatgtagatgaaaagatggtaagtttattgataggtaaaaaatcaagagagggtaataaagaagaaagaataatcaaaagatagagcatgcaaacattacatggtagtattgttataggcggtatattggtaaatgacgatccttgacttagttttttacatcgaacggttgcaaatcctagcatacttgatattaatagtagatactgaaatatatctgagtatatcaagggaaatcgagatgtaacaataagtcgaggaaattaaggtcaatttagtgcttatcatagaaataactacttaagcccttaacgaactaactcaaattaacgaggtagaggttattctgaattgtacgaacgtagtcgaagtttgttaccaagggtaaagccaaaacaaaacgatttgacaagagaatctattccatgtagtagtgcgtttgtacgacgttctattcgatgtaaatcattaggacgagggtttgaagcaactcggaaagatggtcggttagaatttaaaagtactgaacggaattaacgaagttggctactacctaatagtctttgcttaggatttagtagttcgcaattgggtcaaagtggtcgctttggtcgtcgacgtcaagactcaacaagtcatttaccgctgtacgaaccatc

SEQ ID NO: 284 - DNA, 277 bp, Artificial Sequence
  exon
gagtaaacgaacatccaacagtatgtacaatcgtatgagaaaggacaaatctgaagacgatattagagggagtccaacaagtttgtgatgattcacgtaaggaaatcgaaatgtaagattattcgtcaatggaggtataagacaacacaccaagtaattatacgcgacgagttttcatgttgacgatccctgagactatatcatacaaaattgacccaaataataaactcgttccaatagttgaagtgttgattaacacattgagacaagttgtccg

SEQ ID NO: 285 - DNA, 276 bp, Artificial Sequence
  exon
gagtaaacgaacatccaacagtatgtacaatcgtatgagaaaggacaaatctgaagacgatattagagggagtccaacaagtttgtgatgattcacgtaaggaaatcgaaatgtaagattattcgtcaatggaggtataagacaacacaccaagtaattatacgcgacgagttttcatgttgacgatccctgagactatatcatacaaaattgacccaaataataaactcgttccaatagttgaagtgttgattaacacattgagacaagttgtcc

SEQ ID NO: 286 - DNA, 202 bp, Artificial Sequence
  exon
gatagtaaaagtcgaaatctttatattcggttcgatgtactacgttattcgcgactgttctgtcatgatagttttttatatagtcctaataaaaggagtttttaaagtaaatgacatttcagtagtaaaagtttaagagctttttgttctgccagacgttctgatagttgaggaaaacgtgtggtcagctaataacttgtgg

SEQ ID NO: 287 - DNA, 211 bp, Artificial Sequence
  exon
gattagatagtaaaagtcgaaatctttatattcggttcgatgtactacgttattcgcgactgttctgtcatgatagttttttatatagtcctaataaaaggagtttttaaagtaaatgacatttcagtagtaaaagtttaagagctttttgttctgccagacgttctgatagttgaggaaaacgtgtggtcagctaataacttgtggtatg

SEQ ID NO: 288 - DNA, 77 bp, Artificial Sequence
  exon
gtacgaattacgaacaccttaacattagggaaacttagatagttgtacaaagtaacgtataacaagtatcgcgtatg

SEQ ID NO: 289 - DNA, 167 bp, Artificial Sequence
  exon
atgacgagaagcatttcaagaaagcgttgtagcttaaaaagaacgttgcggtgctaaaggagaaagtcgaaaaagcgaaggagttaaaacaaaagccggttattaaatgctggaagaaggaagaacaacaactaaacaaggttgtcaagagcattaaggaagccgta

SEQ ID NO: 290 - DNA, 42 bp, Artificial Sequence
  exon
gataccgaatttagaggccataggttatggaaaaagtcagtg

SEQ ID NO: 291 - DNA, 61 bp, Artificial Sequence
  exon
gtggagaagcaaatacttggataccgaatttagaggccataggttatggaaaaagtcagtg

SEQ ID NO: 292 - DNA, 80 bp, Artificial Sequence
  exon
tggccaaacaacactcgcaaagaatttatgtgcgcttggcaggtggagaagcaaatacttggataccgaatttagaggcc

SEQ ID NO: 293 - DNA, 661 bp, Artificial Sequence
  exon
gttaccatgtaagaagcggtagacgccatggcctagtaggaagaatgcttgttcacggagccgacgaagttagacgagtggcagaagaaagagcattatcttggtactcggactgaatgcgtactacggtcgtccaagttgcaagaggtattagagtcattcgaatagctgtgggagtggtatttatagcataataagtgtaaaaaacattcccaacagcatatgtgtagccaagaagcgttgtgctcgcgactaaaagtcaggtagcagcaggcattaacccagtgatagaacatcaaagtcaaataagtatggtttagcattactgcgtatcttgcgattgcgtgctggtggtcaacagtgcaaacctagtggcttcgcactcaaatgtagacaagcattaaccaactacttctaacgtatgttcaggaagaatggctattctcgtcaggtgaatgcgtaatcgaatgagtagtatggtcgaacgtcccgctatagtctgacacgattcaggcaaagttggagtgcaaagccatgatttggtcgatgcggcaaatgttgcttaggactattctatggtcttgcgtaattgtgaagatttgccagttatctaaggagacgtggtgattcgctctatagctgtatctaatctgccagattg

SEQ ID NO: 294 - DNA, 627 bp, Artificial Sequence
  exon
gttaccatgtaagaagcggtagacgccatggcctagtaggaagaatgcttgttcacggagccgacgaagttagacgagtggcagaagaaagagcattatcttggtactcggactgaatgcgtactacggtcgtccaagttgcaagaggtattagagtcattcgaatagctgtgggagtggtatttatagcataataagtgtaaaaaacattcccaacagcatatgtgtagccaagaagcgttgtgctcgcgactaaaagtcaggtagcagcaggcattaacccagtgatagaacatcaaagtcaaataagtatggtttagcattactgcgtatcttgcgattgcgtgctggtggtcaacagtgcaaacctagtggcttcgcactcaaatgtagacaagcattaaccaactacttctaacgtatgttcaggaagaatggctattctcgtcaggtgaatgcgtaatcgaatgagtagtatggtcgaacgtcccgctatagtctgacacgattcaggcaaagttggagtgcaaagccatgatttggtcgatgcggcaaatgttgcttaggactattctatggtcttgcgtaattgtgaagatttgccagttatctaaggagacgtggtga

SEQ ID NO: 295 - DNA, 112 bp, Artificial Sequence
  exon
gattacggcacttgtagagcacgtatcagacccagctttgaaagaaggctgagttcggttcgggtttcacgtaggcctagaacgaggtatagaagtggttaacaaagatttg

SEQ ID NO: 296 - DNA, 91 bp, Artificial Sequence
  exon
gatcactgcaaaaaggactactcaataatggtttctaaagtcattatgctggtgctccctatggcggtggtcagtactgtaactaaagatg

SEQ ID NO: 297 - DNA, 128 bp, Artificial Sequence
  exon
gattccacatccgttcttgcaattaaagaaacgatgtagaaaacgctttggttggcgacaacttgggcggcaaaataattatggtaggtaattgaagtagcgttaaaacgcaaaaagaaggaagcacg

SEQ ID NO: 298 - DNA, 129 bp, Artificial Sequence
  exon
gaaagaatagctgaactcaaagaagccgacaaagataaacaaagaagaaacggttaatacgattgaggagaaatattcaatccaacggcaactattaacgtttcaactagaatctacgtttcatacgcg

SEQ ID NO: 299 - DNA, 222 bp, Artificial Sequence
  exon
agcgctagtccatgaaaatgtcctagctttgaacgtttatcaaatgcaagttgtgggagttagtcatgtgagagttgtgcaagaaagtgttaacgttctagccgtgctcagtaacaattaccattcggcggtaacaaacgtaagttgtcactgcactcatgagcatgaagttagaccagtagttgggtcagaaattagacgtggtttagtctggttaccgtg

SEQ ID NO: 300 - DNA, 269 bp, Artificial Sequence
  exon
gaattcaatgcagaaactcctatgcacgtcgaactagtctcttgctcagcgctagtccatgaaaatgtcctagctttgaacgtttatcaaatgcaagttgtgggagttagtcatgtgagagttgtgcaagaaagtgttaacgttctagccgtgctcagtaacaattaccattcggcggtaacaaacgtaagttgtcactgcactcatgagcatgaagttagaccagtagttgggtcagaaattagacgtggtttagtctggttaccgtg

SEQ ID NO: 301 - DNA, 182 bp, Artificial Sequence
  exon
gatggttagcgtaaacatggtggaacgtactttgactgcgctgcaagaaatggttgggtcgatcgtaatgctagtcgttacatcggaacaagccaaaacaaatcattcgctggatttagacctactgcacgacgacgtcgacacaagacattcttgaaaggtaattgacgtggacgtttcag

SEQ ID NO: 302 - DNA, 166 bp, Artificial Sequence
  exon
gatggttagcgtaaacatggtggaacgtactttgactgcgctgcaagaaatggttgggtcgatcgtaatgctagtcgttacatcggaacaagccaaaacaaatcattcgctggatttagacctactgcacgacgacgtcgacacaagacattcttgaaaggtaatt

SEQ ID NO: 303 - DNA, 160 bp, Artificial Sequence
  exon
gatggttagcgtaaacatggtggaacgtactttgactgcgctgcaagaaatggttgggtcgatcgtaatgctagtcgttacatcggaacaagccaaaacaaatcattcgctggatttagacctactgcacgacgacgtcgacacaagacattcttgaaag

SEQ ID NO: 304 - DNA, 128 bp, Artificial Sequence
  exon
cttccccatttgaagtcatgtagtggttgtctactttttcattgaagacgtccacctcaacgctatgaacgttagttgagacaatgttaaagcaaacgacaacgtcattgtgatctacatacacagtg

SEQ ID NO: 305 - DNA, 144 bp, Artificial Sequence
  exon
gctacgtggtggatgaacatggatgcgaacgacatttcgaaatatacgcaatgatatccaaccctaccgaaacagcaataattgtagaaggtagcatatcatgccgagtcatcgacatgcctttatcgacacacgacgtgattg

SEQ ID NO: 306 - DNA, 120 bp, Artificial Sequence
  exon
gtgtatttatccgctacgtggtggatgaacatggatgcgaacgacatttcgaaatatacgcaatgatatccaaccctaccgaaacagcaataattgtagaaggtagcatatcatgccgag

SEQ ID NO: 307 - DNA, 124 bp, Artificial Sequence
  exon
gttggtgtatttatccgctacgtggtggatgaacatggatgcgaacgacatttcgaaatatacgcaatgatatccaaccctaccgaaacagcaataattgtagaaggtagcatatcatgccgag

SEQ ID NO: 308 - DNA, 424 bp, Artificial Sequence
  exon
ctgtcaagacccttctataatagtcgaaccagtacggtaagtgggcaacatgcccatataagtcgaagcatttcaaatggttcatccagtagacgacgatgtcctagacagtcatgtctgtcacatctatcacgcctcctacgttgtgccataacgaagaataatagtgataagagacatcgaagctgtcgtagtcgttcgctaaattgcttacaatttagtgctctaagtgaacaatgtttcatcttgagaagcaaacgaagtagaagttgacgacgcattcgaagacgtggacaatgtgacacgagtatcgaaacatgatccaacgaacatcgaagaagttactactgaactacgggtcagcttccccatttgaagtcatgtagtggttgtctactttttcattgaagacgtccacctcaac

SEQ ID NO: 309 - DNA, 513 bp, Artificial Sequence
  exon
gagtggatggaagtgtgttcgactgtcaagacccttctataatagtcgaaccagtacggtaagtgggcaacatgcccatataagtcgaagcatttcaaatggttcatccagtagacgacgatgtcctagacagtcatgtctgtcacatctatcacgcctcctacgttgtgccataacgaagaataatagtgataagagacatcgaagctgtcgtagtcgttcgctaaattgcttacaatttagtgctctaagtgaacaatgtttcatcttgagaagcaaacgaagtagaagttgacgacgcattcgaagacgtggacaatgtgacacgagtatcgaaacatgatccaacgaacatcgaagaagttactactgaactacgggtcagcttccccatttgaagtcatgtagtggttgtctactttttcattgaagacgtccacctcaacgctatgaacgttagttgagacaatgttaaagcaaacgacaacgtcattgtgatctacatacacagtg

SEQ ID NO: 310 - DNA, 141 bp, Artificial Sequence
  exon
gagtggatggaagtgtgttcgactgtcaagacccttctataatagtcgaaccagtacggtaagtgggcaacatgcccatataagtcgaagcatttcaaatggttcatccagtagacgacgatgtcctagacagtcatgtct

SEQ ID NO: 311 - DNA, 45 bp, Artificial Sequence
  exon
gtaaaacttgtcacccccatttacattgcgacagacacagttatg

SEQ ID NO: 312 - DNA, 113 bp, Artificial Sequence
  exon
gagtttactacgttgtagcgagtttagttgaaatagtttgtgatgtgtaaactaaaacataccaaatggtaaaacttgtcacccccatttacattgcgacagacacagttatg

SEQ ID NO: 313 - DNA, 175 bp, Artificial Sequence
  exon
caccgaatttcatcaacaacattaataattccataggaactacattcttaaatccttggaactccaaactcctaccttatcacggttctatccgtcgtcttagggtcggtctcctcgtagcatggcctcgttctcctcgccgtaattgcggtcgaaagtacttcagttatttatg

SEQ ID NO: 314 - DNA, 290 bp, Artificial Sequence
  exon
agactacaaaatctcaatcctccattcccccgtcaggtctatctaaaattcaatcgctgtgtttgcggggtaaataataggacaagtccgtataatctacccaatcgcattcattccagtcagagggtaccaccgaatttcatcaacaacattaataattccataggaactacattcttaaatccttggaactccaaactcctaccttatcacggttctatccgtcgtcttagggtcggtctcctcgtagcatggcctcgttctcctcgccgtaattgcggtcgaaagta

SEQ ID NO: 315 - DNA, 360 bp, Artificial Sequence
  exon
gattcgtcgaacgtccgggtagtatagttatctgcatcgtggtcaccagtatcacagactacaaaatctcaatcctccattcccccgtcaggtctatctaaaattcaatcgctgtgtttgcggggtaaataataggacaagtccgtataatctacccaatcgcattcattccagtcagagggtaccaccgaatttcatcaacaacattaataattccataggaactacattcttaaatccttggaactccaaactcctaccttatcacggttctatccgtcgtcttagggtcggtctcctcgtagcatggcctcgttctcctcgccgtaattgcggtcgaaagtacttcagttatttatg

SEQ ID NO: 316 - DNA, 136 bp, Artificial Sequence
  exon
gttcgactagacctctcgtggtagggcctggaagtcaaaagacttctctatgggtactaggtaggtagttagagtacggtccctggggtgtctcagagtcgaacgttcgggggaagttcctaaacatgttaggatg

SEQ ID NO: 317 - DNA, 476 bp, Artificial Sequence
  exon
gatagtgggggacctgagtcatactagggtaacttcttatatggtgacatcactcctaccgtagaggggggacggtagtctgtgggaaatctaccctagtgaagaaaggtaagagaatgtctgaacattacctgtagacgaaggtactctcagaacaactactctcacatacggaaaggtttgggtccttggtcaaaggactttactgactctgcagacgatgaatatctgaaccaacactactatcaaagatgtcgtaggtttgtgagaagggagaagaagtggttgagaagttggtgttccacaagttaaagtagacatacctttagtacctgtaaaggttcgactagacctctcgtggtagggcctggaagtcaaaagacttctctatgggtactaggtaggtagttagagtacggtccctggggtgtctcagagtcgaacgttcgggggaagttcctaaacatgttaggatg

SEQ ID NO: 318 - DNA, 255 bp, Artificial Sequence
  exon
gatagtgggggacctgagtcatactagggtaacttcttatatggtgacatcactcctaccgtagaggggggacggtagtctgtgggaaatctaccctagtgaagaaaggtaagagaatgtctgaacattacctgtagacgaaggtactctcagaacaactactctcacatacggaaaggtttgggtccttggtcaaaggactttactgactctgcagacgatgaatatctgaaccaacactactatcaaagatgt

SEQ ID NO: 319 - DNA, 256 bp, Artificial Sequence
  exon
gtgtttaggtgtgtcggagggcagaaaccaacgaaagaaaggaaacgatcaacacttatatagtgtcctgtcgggcccaaatcctaagagaccttaggtttaccacattagtactaaacagcctgttgtataccgtgagcccccacttcgatctgtaaatggtaatcccttgtaaaacctcatctccaaaaacagtatacgcaggtacagctgatgtgatcctctctactagtcttctctgaggaaccatgagatg

SEQ ID NO: 320 - DNA, 262 bp, Artificial Sequence
  exon
gagtaggtgtttaggtgtgtcggagggcagaaaccaacgaaagaaaggaaacgatcaacacttatatagtgtcctgtcgggcccaaatcctaagagaccttaggtttaccacattagtactaaacagcctgttgtataccgtgagcccccacttcgatctgtaaatggtaatcccttgtaaaacctcatctccaaaaacagtatacgcaggtacagctgatgtgatcctctctactagtcttctctgaggaaccatgagatg

SEQ ID NO: 321 - DNA, 203 bp, Artificial Sequence
  exon
acgtataggtgtgctctcagctgccgttccggcgctgcttcacccctttccgcttatcgcggatggtaaagtcaaagtttactcagcggtcgctgttgacctcaggttctctatcaaaaatttgctggctaaaacggtcggagcttctgctccactctttccagcaatccttctgccagtcgccttcaaacttgcaatctgtg

SEQ ID NO: 322 - DNA, 240 bp, Artificial Sequence
  exon
gtgaggcatctataccgccacgccctatgtctttctcacgtataggtgtgctctcagctgccgttccggcgctgcttcacccctttccgcttatcgcggatggtaaagtcaaagtttactcagcggtcgctgttgacctcaggttctctatcaaaaatttgctggctaaaacggtcggagcttctgctccactctttccagcaatccttctgccagtcgccttcaaacttgcaatctgtg

SEQ ID NO: 323 - DNA, 210 bp, Artificial Sequence
  exon
gtgaggcatctataccgccacgccctatgtctttctcacgtataggtgtgctctcagctgccgttccggcgctgcttcacccctttccgcttatcgcggatggtaaagtcaaagtttactcagcggtcgctgttgacctcaggttctctatcaaaaatttgctggctaaaacggtcggagcttctgctccactctttccagcaatccttc

SEQ ID NO: 324 - DNA, 84 bp, Artificial Sequence
  exon
gtacaagagttggttactctcagtcccattcccaacacatcactgagaagtatagagcctagtggtcattagaaggtcaacatg

SEQ ID NO: 325 - DNA, 67 bp, Artificial Sequence
  exon
aagccttgaaacggtctgttcctcgtgtcaagttctttgtccgcttataccgccatctctcgttgtg

SEQ ID NO: 326 - DNA, 116 bp, Artificial Sequence
  exon
gttttacaaaggagaacttccaacatcagtgtatgggatgtttcaaacacccccagagacggagacaatagtgtggtcacgtacatttaggaagataaaaataacaacaacagaag

SEQ ID NO: 327 - DNA, 342 bp, Artificial Sequence
  exon
gcttgtccgcgagtgtcaaccgggttttacaaaggagaacttccaacatcagtgtatgggatgtttcaaacacccccagagacggagacaatagtgtggtcacgtacatttaggaagataaaaataacaacaacagaaggtgtgaggcgcaaggtacatgctcttaccccactctcagcacgtagggagcggagtgtggaagaccaacaagcccgtcgcctctaccaaatacagctatcctgaggtgccaggttagaataggccctaccacatctaagccttgaaacggtctgttcctcgtgtcaagttctttgtccgcttataccgccatctctcgttgtg

SEQ ID NO: 328 - DNA, 234 bp, Artificial Sequence
  exon
gcttgtccgcgagtgtcaaccgggttttacaaaggagaacttccaacatcagtgtatgggatgtttcaaacacccccagagacggagacaatagtgtggtcacgtacatttaggaagataaaaataacaacaacagaaggtgtgaggcgcaaggtacatgctcttaccccactctcagcacgtagggagcggagtgtggaagaccaacaagcccgtcgcctctaccaaatacag

SEQ ID NO: 329 - DNA, 484 bp, Artificial Sequence
  exon
ttatgataacaagtccaaacgtggacgtcgtcgctgtcacctctcggaacactagctgaggtggcttaaaaacattccgtaactgagtggtcaccgggggtgaaacatgctgagggttctaccttaacgggaaggtgaaactctccaatgtctttgaaaggactagttgagataacccaaaccgaatccggaggaagaggagaacttggaaaacgttgtacgacgtcattaataacgattccgttcttcccgttcgtgtctataaggatattctttcattgcgaaggtaagcccttttgggtctagatacggactatactcaaaaacccacagaccttccacttggagttgttttaggagacggagtagtagagaaaacttgtggcaccttcccagtcggttccctacagactctccttagtagctcctaagatcgtcgagttacacgacgacattgttccgactgacgtagaggcattacttt

SEQ ID NO: 330 - DNA, 478 bp, Artificial Sequence
  exon
ttatgataacaagtccaaacgtggacgtcgtcgctgtcacctctcggaacactagctgaggtggcttaaaaacattccgtaactgagtggtcaccgggggtgaaacatgctgagggttctaccttaacgggaaggtgaaactctccaatgtctttgaaaggactagttgagataacccaaaccgaatccggaggaagaggagaacttggaaaacgttgtacgacgtcattaataacgattccgttcttcccgttcgtgtctataaggatattctttcattgcgaaggtaagcccttttgggtctagatacggactatactcaaaaacccacagaccttccacttggagttgttttaggagacggagtagtagagaaaacttgtggcaccttcccagtcggttccctacagactctccttagtagctcctaagatcgtcgagttacacgacgacattgttccgactgacgtagaggcat

SEQ ID NO: 331 - DNA, 209 bp, Artificial Sequence
  exon
gtgaggcttgtccgcgagtgtcaaccgggttttacaaaggagaacttccaacatcagtgtatgggatgtttcaaacacccccagagacggagacaatagtgtggtcacgtacatttaggaagataaaaataacaacaacagaaggtgtgaggcgcaaggtacatgctcttaccccactctcagcacgtagggagcggagtgtggaagac

SEQ ID NO: 332 - DNA, 146 bp, Artificial Sequence
  exon
gtgaggcttgtccgcgagtgtcaaccgggttttacaaaggagaacttccaacatcagtgtatgggatgtttcaaacacccccagagacggagacaatagtgtggtcacgtacatttaggaagataaaaataacaacaacagaaggt

SEQ ID NO: 333 - DNA, 144 bp, Artificial Sequence
  exon
gtgaggcttgtccgcgagtgtcaaccgggttttacaaaggagaacttccaacatcagtgtatgggatgtttcaaacacccccagagacggagacaatagtgtggtcacgtacatttaggaagataaaaataacaacaacagaag

SEQ ID NO: 334 - DNA, 80 bp, Artificial Sequence
  exon
gtgaggcttgtccgcgagtgtcaaccgggttttacaaaggagaacttccaacatcagtgtatgggatgtttcaaacaccc

SEQ ID NO: 335 - DNA, 25 bp, Artificial Sequence
  XhoI site - T7 promoter
ctcgagctaatacgactcactatag

SEQ ID NO: 336 - DNA, 35 bp, Artificial Sequence
  polyA-tail - NsiI site
aaaaaaaaaaaaaaaaaaaaaaaaaaaaaatgcat

SEQ ID NO: 337 - DNA, 20 bp, Artificial Sequence
  Primer
gctaatacgactcactatag

SEQ ID NO: 338 - DNA, 26 bp, Artificial Sequence
  Primer
  variation 26: v = any of a,c,g
tttttttttttttttttttttttttv

SEQ ID NO: 339 - DNA, 12643 bp, Artificial Sequence
  SIRV1
agagttccttcctccatacgcagttatgcaagtcattgctgtatcccataaacctgtcaaagtcactgtatccggttatgtaaggtctagaggaatgcgtagtcatttatggaaatatctcagctaagtgtagttgcggtaaaatgtgtgtagcggctgctgttttcccgactttcaccgtgagatgattaaacaagtacactcttgttatttgttataagctcatgtgcagctaccctatcacgagagcggtccggcgggtgaagcattaacaggaaactcatcacgtcggcgtaattaaatcgtacaccggtcgtggaatcgcacttcgctagcagtttaacatgcgtgcggtccaaccctacatacacgatacctgaaaatcgcgatgggcttagtaacgggtagctaaaacggtattccgaagcggcgcatcaattcgctaaggtgtggttgttctcattacacggcttagatacaattatagtggcaaggaacacaattagttattaccaacggcgacgaatagtagtttacttcctccctgcgggcccctcctgaagtgccacctatacggcttgttgaagccgattagtacaatagatttattcaaccccaaaggtctacactcccggcttactcttagctgatatgtcgcgtcgagtcccgggtttgagtgcgttagcgccgggttgtctggcccagttcgacttttgggtacctcatcgggttacactggctgacacttattcttcagataaggttcccttattgggactagtaactgaggtttgaaactatccctacttctaatggtcttaactctttcgcatgaatgacggtacgagcttaccttacgaggttatcacttatccaagtgcagggtgctcttccagctcttgaagaggacgtagagagttggatgtattagatgggcgtacgcattatgtgcccacttgtatgattgtgcgttttcaaggaaggaagtatgcatcgattcaaagtaatgcctctacgtcagtcggaacaatgtcgtcgtgtaactcgacgatcttaggagctactaaggagagtctgtagggaaccgactgggaaggtgccacaagttttctctactactccgtctcctaaaacaactccaagtggaaggtctgtgggtttttgagtatagtccgtatctagacccaaaagggcttaccttcgcaatgaaagaatatccttatagacacgaacgggaagaacggaatcgttattaatgacgtcgtacaacgttttccaagttctcctcttcctccggattcggtttgggttatctcaactagtcctttcaaagacattggagagtttcaccttcccgttaaggtagaaccctcagcatgtttcacccccggtgaccactcagttacggaatgtttttaagccacctcagctagtgttccgagaggtgacagcgacgacgtccacgtttggacttgttatcataactgattatgagtaaccgcaagacagtgtaaacactgtaatccatacttgattgagatcccttgaaaatgctggtaccattttctaaactcgatggtttgttgacaattatttgtacagcgacgcatctagcggttcttggtcgaccctactcacgcaataaatgcagcacgttcgacccagactcatccatggtagcttcaaatacggattcaacctggcgtttatatccagaaaacggccctaggggtgatagacacttaacactttgggcaaccattggacatgtttcacgtatcgatatagtaaccattattctgcatttgcctcctagcgagtgaggaagaagcctttctattggcttcttaatcctcccataccacgcgcgtacctttcccggcccttcattgagaccggaagtgccttgttattcaatgttaaacccttgtcagcctatcgcggtgatgcacgaaaaaaccaaatggagtatagagcatcaactactcccaattttaagtgccctcttctaggttgcattcatatatcaatgtagacttcgcaagctagtgaatgagggaaatgaatttatccggaatgacaaaggggaccgagcattcaagatgcgaaccgttagatgggcgttccagtctgcacagtaagcctttgttttttaaccattgaaggaatcgacttcacgacccttgcgagttcagtcatcagaagaagagaccttcagcgctccccccctgaaatagtacagcttcaaacaataacctgagtaagttggtatccgaggtactatgagtttctcgaccgttcgacgcccccatcctatgtttaaagagctgtcatccctagcctcgagcttacacaggaaccagctgagtctaggctgggcccacttgggttgcttgcatatacaaaatgatgtacaccgcaggacctgtcccttagggaattgtggttgaccaaaagtccgctacccatcggcgtcgtgtcacttttgtgccgataggtatgatcaatctcttggaggctattacgatgttggtaaaagattagaactgctagacagctgttgataatcaagtcgctccgtagattgccgagaatcagttgagatgagtacgttatttagggcgcacgagctgcgattgagttggtaccatcgtagtttacgcctatgttagtccccaattatacgccctttgcccgaatccccactatctgtgaaatgtttaacgcgttcgctacctctacaaaatacatagctacgtcatacgtaagaatatcttaacggaggatcgcacactctctcctcggacagataagcggggaagtaggagggtatggtgcacgcatggaaagggccggtaagtaattctggccttcatggaacgatatgttataatttggaaattgtcggatagcgcgactatgtgcttaattggtttacttcaaatctcgtagttggtgacagtaaaaattcgccggagaagttccagcgtaagtatatggttacaactgaacgattccaggatttactcccttaagctaattagacctatctgtttcccctggctcctaagttttgcggtcggcgatttacccgcaaggagacgcatgtcattcggaaataaaaaattggaaacttctttggctgttgtgctgggaacgctcatgtcaatacttttcttctctagaagttgaaagggggggatattatcatgtcgaagttcgttataagagtcattctaccatgcacaccatgattctgaaagtgctggcaagctgcgggaacgagatacatatttctcatcactagggctcagacctcaagtgagtcgttggtcaactcaggtccgagtcggaagaacccaacgaacatgtaactctcactacgcgtgttgtcctggtcagagcactccttaacactaactggttttcaggcgatacgtagctgcggcagagtcaagtcatgggtattgatagtagttagagaaccaccgataatgttacaaccgttttctaattttgacgttgtgtgggcaactattagctgagcgagctaactaacagctcttacaaatctctactcatacaataagttccgtgagctcaacactaactcaacctgggtaacatcagatgccgatatattcaggggttattatgcgagatatgcgcttagggatagtagacacttcacaagttgcgcatgcgatcgagacattttatgaatcgatgcaatgtgcattcttatagaattgcctgttagcgtaacataggtgaacgtgcctaattaccctctcacccgcgcttattgcatccgtaccatttccggccattcattaagatcggaagtaccttgcgatacaaaattaaacttcaaatgccctatcacgcggatttagcagttattttaatcaactttagtggaccaatcatagacatttttaggcggtattttcggggtggcatttaaatactaatgatgacatattagggtcttaaatgagagaattcgattaatttggttagacaaggggatccgaagatattttaccgcagccactaaaagggcgtacctctgcctacaataagcctttattcttaaatgtctgaagaaaccgcgaagacggctgtcgtcaatacaaatatgataagagcagtactacatctttgctccgcaataacggtacagcttcaggtaatattcacagtaaaatggtacgtccggtactaagactttcatgactgttcgacgtttatgctttaggtatgaagagtagtggcccggtgtctggagatcatcctacatccgattgactccaagcacagccttctcggcttgctagtacattgagagtgatacgctcaactggacgagactcgagaggaaatacgactgaccgtaagaccgctttgttccgacaccgtcttagcacagcactcatgattatcatcactcttttagtgcctattacaatgctggcaagagaataaatctccatcacactccttgaaaatgcacttggtcgtttgattgttgagaaagtttaatgatgagtatgttattcaaggcactggtgtactgatagagttgggctagatgttaactacgagtgtataacccttcaatgactcgctctatacgcaaattcctatcatctgtgaagtgttcaacgcctatggcaactctgtagaatattcatctgcgttacaccttagaatatcttagcgggctatcgcaacacatccacttgtgccgattaatgggagagtgggcgcgataatcgaaggtatggtggacgccggtaggtaattctaggcgacaaggaatgctattttcttaattattctttagggcattgtacgcctaaatcatcagcaaaatttgttgaaatcacctcgcttgattttgtaaagatctgtcttaaaaccgtcaccgttaattagagattactacactataatcccagaatttacattcttaagctatttaaactaacctgttcccctaggcttctataaaaccgcgtcagtgattatccccctcggagacggatgtttttcgcgaataacaattgacagattcctatgtcgcttccgccgtcagcaattttgttttcactatactcgttgtgacgtagattcgtcgcgttattgcgttgtcgaactccataaaaagcgtctctttgccgtgcaggtcaagattgtgaaagtatagacgagcagcaaatacgaaaaccgcacttttgaccacgcggccacagacctctggtaggaagaacgcttactgaggttcgtgtcggtagtgccaaacatccatgtgaccctgacagtgcgaattgacctgccttgagctcttccatatgctgactagcattctggcgaaacaaggctgtggtagtattgtgccgtgagtactaatagtagtgaaaaaatcagggataatgtctcgacggctcacttacttagaggtagcgtgagacacctttacgtgaactagcaaaacgacatctcttttaaattatttgtcttacagttacttccgtgatgacatgattatcccggcccgatgtacaattgatgttctcatattggaaaactactgggccagatatgtattaaagcatagcacgtacatcgcaagttccggatatcgttaagactacttataagtaatcccattgcggaatcttataatatgacccgatagcgttgtgttggtggagacggcagattacgctctcaccggcgctattagcttccataccagctggcaacatccattaagatccgctactcctcaggaaaaaagtatttataagaagtcctgtaacatgtgcatttgatagtcctaattgacaacattactcgggcgaactaaaacccttgagcacagaattttagcagaggctaataatgtgatatgatatgaaattagggtctatatagttataatttggtgagttaaattggattaggagtttggaagatgatttggcacagttagtcacagacgaaggacttgccttcaaaaagcggttactgttgtctgtcttgggtttcagcgaaagcaggagtcgttgaagcaaaagtaatatgtccgacattgcatctaggcaaggcaacttcgcaacaggtcaacctgttctttgtagagaaactagaggtccagttcaaacactctcatttgtgcagctcgtttatgcatacggcgtgtaaactggtgcgtcggtgtatggagaccttccttcttgcgtatgattgcatggactgcgatcacgttttgtgggttcactgggactgtcacgcttaatcgctcggaattcgagaaagcaaacgacaccatcctaacatgtttaggaacttcccccgaacgttcgactctgagacaccccagggaccgtactctaactacctacctagtacccatagagaagtcttttgacttccaggccctaccacgagaggtctagtcgaacctttacaggtactaaaggtatgtctactttaacttgtggaacaccaacttctcaaccacttcttctcccttctcacaaacctacgacatctttgatagtagtgttggttcagatattcatcgtctgcagagtcagtaaagtcctttgaccaaggacccaaacctttccgtatgtgagagtagttgttctgagagtaccttcgtctacaggtaatgttcagacattctcttacctttcttcactagggtagatttcccacagactaccgtcccccctctacggtaggagtgatgtcaccatataagaagttaccctagtatgactcaggtcccccactatcctagctctccttaatgctgactggcattctggcgaaacatagctgcggcagaatcgagtcgtgagtactaatagtagtaagaaaatcacggataatgttacgaccgttctcttattttgaggtagtgtgaggaacttttacctgaaccagcaaactaacaactctttcaaatcactactcatacaataagttccgtgagcacatgactatctcaacccggataacaattgatgctcacatattgggaagttactgagcgagatatgcgtttaaggatagtagacacttcacaagttgcggataccgttgagacatcttataaatagacgcaatgtggaatcttatagaatcgcccgttagcgttgtgtaggtgaacacggctaattaccctctcacccgcgctattagcttccataccacttgcggccatccattaagatccgctgttccttacgataaaaaaattaataagaaatcccctaacatgcggatttagtagtcgttttaaacaactttagtggagcaaactaaaacatttctagacagaattttggcagtggcaattaatcactaatgatgtgatattagggtcttaaatgtaagaattcgataaatttgattagacaaggggatccgaagatattttggcgcagtcactaatagggggtgcctctgcctacaaaaagcgcttattgttaagtgtctaaggatacagcgaaggcggcagtcgttaaaacaccatctcatggttcctcagagaagactagtagagaggatcacatcagctgtacctgcgtatactgtttttggagatgaggttttacaagggattaccatttacagatcgaagtgggggctcacggtatacaacaggctgtttagtactaatgtggtaaacctaaggtctcttaggatttgggcccgacaggacactatataagtgttgatcgtttcctttctttcgttggtttctgccctccgacacacctaaacacctactcctaaagcatgtacatcgcaagttcccgatatcgtttaggctaccatttactaaccccattgcggaatcttattatatgatcggatagccttgtgttcgtggagacggcacattaggctcgcaccggtgctattaccttccataccagctggcaacaacgattatcatccgctactgggcaggaaaaaagtatttaaaagaagtcttgtaacaaatgtattacatggtcctaattggctacatcactcgggcgaaccaaaacccttgagcacaaaaattaagcagaggctaatcgcgtgatatgatttaaaatttcggtctgtatggctataatttggtgagttaaactggattagcagtttgctagacgatttggcacagttagtcacagacgaaggactcactatgaaaaggcggtttcagttgccaatcttggatttcagcgaaagcaggaaccgatgtggctaaagaaatacgtccgtcattgcatctaggtaaggcatcttgccgaaaagtgaacctgtactttgtaaaggaactagaggtcctctttatgctctgtggtttgtgcagctcttttatgcatacgacgagtaaacaggtgcgtgggtgtatggggaccttcctttttatgtatgatcggatggactgcgatcacattttatgggttccctgggactgtcacgctaaatcgctcggaaattgagaaagcaatcgactacttgcaatgacgcactgaccgaactcgagcataacgggtcacacaccataatcttcgcctctttagtcccagtcattcagcaccgcggtagacgtgtaacaaccggccactgcccatctacatatgatcgtattgctttagaattaacttaataaataggatgcgcggggaggatctactgtacttatgcgaccacgctacgtactaacttgaaggctacgtcctattcttggccttgtgcatacataacatgaatacgtacatgtaggattcagaagttgtagcaaatcccacgctgaacgtttggggaaaggcctcagcattatatcctagcctgtcggaacacaagcacctttcccatgtaaacccagcgtcatcaccacaatgaatagtccgaccgatcgttattgctattagtacatgatgactcgtccttctaacacaaattttctactgaatattgattacaaaatgtaccaggattagccaacgtggcgagcccccctggttttgggtactggtgattttatttcgactcagatcagcgcactaaactgaattctaaagctagacatgcagatattaaagctctctatttgacctagtcgataaacaatcagctagaccgtgtcttactgtgtctgcttcttgagtgataccttaccgccgaagtcgacggttactacctagggtcgccttgatccttcgctacaccggactccttatggagagagtaacgtaaatctattttgtagagcgacctttcccttggtcatgaaacatttcgttgatctctaagagaaatacgagacaccaagcaggccaagaattttcgtttgctcctcattagtccacgcacccgttttcgcttgggagtaaagattcatgttagtctacctgatgctaacgtaaaataccctagggacgccgacagtgccattatgtgagcctcttactgttaggttaggtgttgatcgatactgggtgactggctttacctcgtattgcccagagtgcggtatttaaaacggtcaaattaggcccagaaagttgtaacgccatccgcacattgttggctggtgaccggtaggtgtacaataatataaggtattcaaaattgaattatatatcctttgcgcccgtcctagatgacacgaacacagtggaacgatgcatgattctgcattcgatccaggttatgagcgggaactcgtatttaaagtttttgtccctgtgaaacctgagccttcaacatcgtttagggtgggacttgcgaaccccttgccaaagtcgtaatataggatcggacaatcctgtcttcgtggtaagggtgcatttgggacgctgaagtagtgtaacttatgagggaggctaattatagcaaaaactatataccagtgagctggaagattgtgtttaaaagatgactaataaatattgttgtacatgctcctaatcggttccgcggctcgcgggcaccagaacccatgacctctaaaatagagctgagtttagacgcgcgatttcacttaagatttcaacctgtacgtctattgtatccagggatatactgcatcccctatcagtctatcgatctcgcatacaatgactcagacgaagaactcactatggaatcgggggatcgggcgccaacgatcgttccgatcagaacaagaaagctatgtggcctgacgaatacttctctcattgtgtttagataaaagatcccgctggaataggatccagaccatgttgaccttctaatgaccactaggctctatacttctcagtgatgtgttgggaatgggactgagagtaaccaactcttgtacctatattaacactcaagagttgcttcctccatacgcagttatgcaagtgattgctgtaatccataaacctgtcaaaaccacaacgagagatggcggtataagcggacaaagaacttgacacgaggaacagaccgtttcaaggcttagatgtggtagggcctattctaacctggcacctcaggatagctgtatttggtagaggcgacgggcttgttggtcttccacactccgctccctacgtgctgagagtggggtaagagcatgtaccttgcgcctcacaccttctgttgttgttatttttatcttcctaaatgtacgtgaccacactattgtctccgtctctgggggtgtttgaaacatcccatacactgatgttggaagttctcctttgtaaaacccggttgacactcgcggacaagcctcacgtgtcatgtccaactaccctatcacgagagcggtccggcgggtgaggcattagcaggaatgtcatcacgtcggcgtaattaaatcgtgcagcataaataactgaagtactttcgaccgcaattacggcgaggagaacgaggccatgctacgaggagaccgaccctaagacgacggatagaaccgtgataaggtaggagtttggagttccaaggatttaagaatgtagttcctatggaattattaatgttgttgatgaaattcggtggtaccctctgactggaatgaatgcgattgggtagattatacggacttgtcctattatttaccccgcaaacacagcgattgaattttagatagacctgacgggggaatggaggattgagattttgtagtctgtgatactggtgaccacgatgcagataactatactacccggacgttcgacgaatcctgaacgcaactagttattacgaacggccacgaatagtagaaaacttcctccctgcgggcccctcctgaaatgccacctatacgggttgttgaagccggttactacgacagatttattcaaccccaaaggtctacactcccggcttactcttagccgatagcacagattgcaagtttgaaggcgactggcagaaggattgctggaaagagtggagcagaagctccgaccgttttagccagcaaatttttgatagagaacctgaggtcaacagcgaccgctgagtaaactttgactttaccatccgcgataagcggaaaggggtgaagcagcgccggaacggcagctgagagcacacctatacgtgagaaagacatagggcgtggcggtatagatgcctcacgcaacttcggctaatcatgttatctaaataagttggggtttgcagttgtgagggcgagatcagattcgactatacagcgcagtccggagccctaactcacgtaatcgcgaccctacagagcgggtcaagctgatgacccatcgagtagctcaatgtgagcgagtgtgagtaggaagtctgtcgcaaggcaataatcctaatcattggcagcaagctttgataaggatgaaggttagcacaattcagaaggcgtacttactgccatactcgaacggaatgctttattaaagaaaaggttgacgtcccacgggaagatcgagaacttctcctgcatctcacaacctacataatcttcgggcatgggtagtagataggtgaacatacaaatacggaaaagtttctaccctcacacgtagctaagcaagtcatagctataccccacaaacctttcataatcactgtatcgggctatctaagagccaatggcatggctagtcgtctatggcagtttgtcagttaggtcaagatgcggtaaactgtgtattgcggctcctattgtcccgacttaaactgcctgatgttataacgaatacacagtggttaattgtcatttgcttatgcactgctacgccttgtggaggccggtccggcgcgcgaagcatataaatgaagctcgtcacatccacatagttgtatcgtacgtcggtgtaggaatcgaacttggcctctaattccacatgcgtgcgctgcaagtgtaagtgtaccaaatctaaggaccacgatgggctttgtttcaggtatccaaaaggaaattctgatgccgcgcttcgattcactaaagtgtggatgttccctttatacgggtttgatactcttgttgtagcaggcatctttgttagctagcactatccccaacgtataacagtctacttcctcggtgtgggcccctcgtcaggtgcctgccgtggagcacgttgaagccgattggtataatagattt

SEQ ID NO: 340 - DNA, 6911 bp, Artificial Sequence
  SIRV2
tttatcttgcgtatgggcctacgctacttacacgatacctggtattcgtaatggtcttaccaagcgtctgctgaaacggtattccgaggcgctgcgttaaatcgctatggtgtggttgttctcattagtcggcaaagagacaattatagcggctaggaacgcaactagttataacgaacggcctcgaatagtagaaaatatccctcctccgggcacctcctgaaatgccacatattcgggttattgaaggcggttaccacggcagttttatccagcctcataggtctttattccggggttactcttaccggctgtgacgcgtcgtgtcccggctttgagtgcgataccaccggattgtctggcttggttcaccttttggattcctcatcgggttatactaactgacacttattctttaagtaaggaccccttattggcagtggtgagtgagatttggcactatccttattactgatgatcttacccctgtcgcatgaattacagtacgagcttactttaccaggataccacttgatcttgtggaggatactcttccaattcttgaactggacccacagagatgagtgtactagatgggcgtacgcattatgtgcccagttgtataattgtgtgttttcaaggaaggaggtatgcgtcaatacgttcagtatcgacataaggtatttggatagtttcagtgacatagaccaatagattccagatctccttacgcatcagtaaatacctttatagagtcgattcacatcaacgccattttacacacatcgccgacgacaaaagggctgaaagtggcactctactaatttgttcatgtgtgaacaataaacaatattcgagtacacgttgatgggatagtgctctcgccaggccgtccacttcgtaattatcctttgagtagtgcaggcgcattaatttagcatgtggccagcatcttagcgtgaagcgatggtcaaattgtacgcatgccacgttgggatgtcaatctggcagattagatacagctatagagcgaatcaccacgtctccttagataactggcaaatcttcacaattacgcaagaccatagaatagtcctaagcaacatttgccgcatcgaccaaatcatggctttgcactccaactttgcctgaatcgtgtcagactatagcgggacgttcgaccatactactcattcgattacgcattcacctgacgagaatagccattcttcctgaacatacgttagaagtagttggttaatgcttgtctacatttgagtgcgaagccactaggtttgcactgttgaccaccagcacgcaatcgcaagatacgcagtaatgctaaaccatacttatttgactttgatgttctatcactgggttaatgcctgctgctacctgacttttagtcgcgagcacaacgcttcttggctacacatatgctgttgggaatgttttttacacttattatgctataaataccactcccacagctattcgaatgactctaatacctcttgcaacttggacgaccgtagtacgcattcagtccgagtaccaagataatgctctttcttctgccactcgtctaacttcgtcggctccgtgaacaagcattcttcctactaggccatggcgtctaccgcttcttacatggtaacctggaggatatggtgcgcacatggaaagggccgggaagtaactctggccttcacagaacaataagttacaatttgggaaccaaatctttgttaaccacttctatacctcgttctaggcctacgtgaaacccgaaccgaactcagccttctttcaaagctgggtctgatacgtgctctacaagtgccgtaatcctgaagtgctgggaacgctcaaatcagtagtcttcttctctggaagtcgcgagggggggattttatcatgtcgaagtttgttattggactcattcaaccataggctccatgatactgaaccatctttagttacagtactgaccaccgccatagggagcaccagcataatgactttagaaaccattattgagtagtcctttttgcagtgatcctcatcaaatgcggatacaatcaggggttaatatgcgggaaatgggcttagggatgatagacactttacaaattgcgcaagcgatcgagatgttttatgtatcgatatagtatgcattcttatagaattgcctcctagcgtgacagagacaagcctatctattcgctccttcatcctcccataccacgtgcgtacctttcccggccattcattaagaccggaagtaccttgctatacaatattaaacctttaacagcctatcgcgctgatacacgaattaaccaaatgaagtttagaggatcaaccactgtcatttttaagcggcttcttcaaggtcgcattcatataccaatgatgacttactaaggttctaaatgagagaattcaattaatctggatagacaaaggggtccgaagattcataacgccagccactaaatgggcgttcctctgtgtacagtaagcctttattttttaacctttgaagaaaccgacaacacgacccttgcgagtacagttatgaaaagaagagatcttcatctttgcccccctataatagtacagcttcaagcaatattctcagtaagatggtacgtgtggtactaagaaccgtgcttccttctttttgcgttttaacgctacttcaattacctaccataattattttgccgcccaagttgtcgccaaccaaagcgttttctacatcgtttctttaattgcaagaacggatgtggaatccttcgcaacacaaccacttctgccgtgtaatccgagagtggccacgataatcgaaggtatggtcgaccgttgtaggtaccgcgtatgaaacgtagattctagttgaaacgttaatagttgccgttggattgaatatttctcctcaatcgtattaaccgtttcttctttgtttatctttgtcggcttctttgagttcagctattctttccttggaagtttttcgccaaaaacaacagacagaacctaaagtcgctttcgtcctcagcaacttcgttttctttatacaggttgtaacgtagataccacggtaaccagactaaaccacgtctaatttctgacccaactactggtctaacttcatgctcatgagtgcagtgacaacttacgtttgttaccgccgaatggtaattgttactgagcacggctagaacgttaacactttcttgcacaactctcacatgactaactcccacaacttgcatttgataaacgttcaaagctaggacattttcatggactagcgctgagcaagagactagttcgacgtgcataggagtttctgcattgaattcctaattaacgagccttaaactctttcatttgctgatgagcattattgcgagactagcttgagctcgtattgcccggtgtgtactattagaagtgaaaaaatcagggttaatgtctcgtcgcctcatttacatacagatggccggtgacacctagacgtatactagcaaaacgacatcttaattgaattatttatcttacacattcttcctagatgacatgaatatgctggtccgatgtataattgatgttccgatataggataacaaacctgaaacgtccacgtcaattacctttcaagaatgtcttgtgtcgacgtcgtcgtgcagtaggtctaaatccagcgaatgatttgttttggcttgttccgatgtaacgactagcattacgatcgacccaaccatttcttgcagcgcagtcaaagtacgttccaccatgtttacgctaaccatcctgtactttgtaaaggaactagaggtcctctttatactctgtggtttgtgcagctcttaaatgcaaacgacgagtaaacaggtgcgtgggtgtatggggaccttcatttttatgtatgatcggatggactacgatcacaaccactgtgtatgtagatcacaatgacgttgtcgtttgctttaacattgtctcaactaacgttcatagcgttgaggtggacgtcttcaatgaaaaagtagacaaccactacatgacttcaaatggggaagctgacccgtagttcagtagtaacttcttcgatgttcgttggatcatgtttcgatactcgtgtcacattgtccacgtcttcgaatgcgtcgtcaacttctacttcgtttgcttctcaagatgaaacattgttcacttagagcactaaattgtaagcaatttagcgaacgactacgacagcttcgatgtctcttatcactattattcttcgttatggcacaacgtaggaggcgtgatagatgtgacagacatgactgtctaggacatcgtcgtctactggatgaaccatttgaaatgcttcgacttatatgggcatgttgcccacttaccgtactggttcgactattatagaagggtcttgacagtcgaacacacttccatccactcctaattcttgaccttgtgcatatataacatgaatacgaacatgttggattcagaagttatagcaaatcccaccctaaacgtttggggaaaggctttagcattatatcctagcctgttggaacacaagcacctttcccatgtaaacccagcgtcttcaccacaatgaatactcccaccgatcgttattgcttttagtacatgatgacaccataactgtgtctgtcgcaatgtaaatgggggtgacaagttttaccatttggtatgttttagtttacacatcacaaactatttcaactaaactcgctacaacgtagtaaactcctagtccacgcacccgttttcgcttcgatgtaaagattcatgttagtctatctgatgctaatctaatataccctaggcacgccgacagagccattatgtgagcctcttactgttaggttaggtgttgttcgatactgggtgactggcattacctcgtattgcccagagtgcggtatttaaaacggtcaaattaggccctgaaagttgtaacgccatctgcacattgttggctggtgaccggtaggtgtacaataatataaggtattcaaaattgaattaaatatgctttgcgcccgtcctacatgagacaaacacagtggaacgatgcatgattctgcattcgatccaggttatgagcgggaactcgtatttaaagtttttgtcgctcaaaaacctgagccttcaacaacgttttgggtgggacttgcgaaccccttgccaaagtcgtaatataggattggacaaacctgtcttcgtggtaagggtgcaattgggacgctgaagtagtgtaacttatgaggaaggctaattataacaaaaactaaattccagtgaggtggaagattgtgttttaaagatgactaataaatattgttgtacatgctcctaatcggttctacggctcgcgggcaccaaaacccatgacctctaaaatagagctgagtttagacgcgtgatttcacttaagatttcaatctgttcgtctattgtatccagagatatactgcatcccctattagtctatcgatctcgcatacaatgactcagacaaagaactcactatggaatccgaggatcgggcgccaacgatcgttccgatcagaacatgaaagctatgtggcctgacgaatacttctctcattgtctttagataaaagatcccgctggaataggatccagtactttgtaaagcaggttgagaatcttgtaatgttttgaagatcatcggaccaatcacgtcgtgtgtcgataaaggcatgtcgatgactcggcatgatatgctaccttctacaattattgctgtttcggtagggttggatatcattgcgtatatttcgaaatgtcgttcgcatccatgttcatccaccacgtagcggataaatacaccaactacctggttgtaaattttgcagcgttaagaacatcaatggatcataaaaataaaacgtgcatcctctagtaacaaaatctaagatctagacaaacttccaactagtctgaacttagattaaagaggtttagtaggtacacggactctgtcgtatatattactttaagtgaaatgttttccagtgttgatcaatccctgaatagcaaacgattataatgagactagagtgtaaacgttagcgacgaccgagaggttcttagcggcatcatagttacctctcggctctagtatctcacaaatggtcgccgatctgatagattgctcgataatctccgtgtgctttcgtctgtatggcggactttataaatctagtatcagtctggtttaaacgatgctgagcataagtgtgcttgaaaaccgccacataaagggtaaattcgaaaacaacgagtgtcctgtgaaccatatgcataactagagtaccccgcacgctagcatgacacatgcctccgcaaggctattcttcgatacagtataaatagattcattcgcctatttttctgtttatatgcgttatatttacgttgtctttaattacctgccagagttaaagacattccattgcgtgggaccgggttttcagtaattcgctatattagcttgaagaccagttgggcaagacccgacaagttggttgtgaatgcccccgaataattctcctaaaactatgcctgggtgttggcagcagtccattgaaacttcaggcagaaaggcctagccggcttaagcgagtggaaaaacttagaagcgtcctgtattgattatcgaggaaatactttctcatttgtgacggatttccacctcccggttctcaggaaggttaaaggtgtaattactattgacgtgactgcagaggagaagagatcttgttttcattttttggcggtaacgtgatcctgaatggcgcttatgacggagcaatgtatttaacgtcggagtc

SEQ ID NO: 341 - DNA, 10943 bp, Artificial Sequence
  SIRV3
aatatttcaggcggtatgtttactttcatgtacctttaatagctcgttagatagtttagctgctggtaaacactctatgatctcggctctccattgatactacgacgattattagagagccagcaacaattgcaaatgtcagatcaaagtaatattagcaaacaataagtccctaactagttgtgaccttttgtaaagtgaatttcattatatatgctgtctctagcacatggataatttggagaaattagattcaagtctgatcaacctttaaacagatctagaatctaaaacaatgatttcctacgtgcaaaataaaaatactaggtaactacaagaattgtgacgttttaaatgttggtccattagaaacaccatttaggattacgttaccctaaaaaaaagatatcaggaactcttctcttttgcagtcaggtctatagaaactacatcattaaccttcctaagaaccgggaggtgggaatctatcatatatgagaagatatttgctcgataattaatactctaggtttctaactttttccattcacttaaaccgacttaacttttctgcctgaagattcattggattgatatcaacgcgcaggcatagttccagaaaaattatccagaagcaatgacaaccaacatttcgggtcttgcctaatcggtctacatgttgatataataaatcactaaaaactcagtgttacacaatggaatgtccttaattctagcaggtaattaaagggaacgtatatataacgtaaaaaaattggaaaattaacgagagaatcttctttctgtctattgaagaatggctatatagaagcatgcgtcatgctagcgtacagggtactcttactatccatttgggtcacaaaacactcgctgttttcgaatttaccctttatgcgccagtattgaaccacgcttatgtctaacatcgttacaaccagactgatactaaatatataatgtccgccatacaaataaaattatgacgagaagcatttcaagaaagcgttgtagcttaaaaagaacgttgcggtgctaaaggagaaagtcgaaaaagcgaaggagttaaaacaaaagccggttattaaatgctggaagaaggaagaacaacaactaaacaaggttgtcaagagcattaaggaagccgtactatgttacatttcttcaaccttctaattgcacccttaggacgaagacagatatgttcttacctatatttcatcattggcaacgggatcgcatgtcccacgtaaaacattgttaaaccctcaggtttttgagcgacaaaaactttaaaaagaaattcgcgctcataacttggttcgaatacagattctagcatcgttcgtctgagtttgttttatataaaacgggcgcaatgtttattttaatcaattttcaataccttatataattgtacacctaccggtgaccactcaataatgtggggttcccgttacaactatgaggatttattaagaccgatttatattcggcattgtgggcaaaatgacgtttcaacaatgcccaagttgacattattccaaaacgtttcgtagaaatgaaagcgcttcgagtaattaggcgcaaacttacaggacgccatggcatatgggtggtagaaccaacgatggaagcgagtagcgcaatgccttagcgcacgcctacactaactgcttacgaagttggagcaaaagaaactgaacgtgtcagccaaaattgccaagaaacaggagctaccaaaagctagtccggtgtatcgaaagtacaagactagccttgctagtaaccgtggactaggagcctaaggtatcactcaagatacagactcagtaacatacgctttagctatttaattatcctctatgtcttatagagacctactggccaaacaacactcgcaaagaatttatgtgcgcttggcaggtggagaagcaaatacttggataccgaatttagaggccataggttatggaaaaagtcagtggtatttaggcgtacaatgccttaaagaataattaaaaaaaaagcattccttgttgcctagaattacttaccgcggtttaccataccttcgattatcgcgcccactttcccattaatcagtagaagtggttatattgcgatagtccaatatgatattctaaggtattacgttgataaatattttacagagttaccataggcgttgaacactacacagataatacgaatttacgtatagagcgaattattgaaaagttatattctcgtaattaacatttagtccaactctatcagtacagcagtgccttgaataacatactcatcattaaattttctctacaatcaaacgaccaagtacattttcaagaagtgtgatggagatttattcttttgccaacattgtaataggcactaaaagaatgatgataattatgagtactgtactaagatgatgtcgaaacaaagcggtcttatggtcaatcatatttcttttcgagtttcgtccagttgagtgtatcactttcaatgtacttgcaagccaagatggctgtgcttagagtcaattgcatgtagaatgatctccagacatcggaacactagtttttatacttaaagcataaacgacgaacagtcatgaaagtcttagtactagacgtaccattttactgtgaataatacttgaagctgtactattattgcgctgcatagatgtagtactgttcttatcatatttgttttgacaacagtcgtcttcacagtttcttcaaacatttaaaaataaacgcttattgtagacagaggtacgccctattagtggctgcggtaaaatatcttcggatccctttgtctaaccaaattaattgaattctttcatttaaaaccttaatatgtcatcattagtaattaaatgccactttgaaaataccgcttaaaaatgtctaagattgatccactaaagttgtttaaaataattgctaaatctgcgtgatagggaatttaaagtttaattttctattgcaaggaactaccgatcttaatgaatggccggaaatggtatggaagttataagcgtggatgaaagggtaattagatatgtttatctatgttacgctaacaggcaattctataagattgcatattacatcaattcataaaatatctcaatggcatgcgcaatttgtaaagtgtctattatccttaaacgcatatctcgcataataactcctgaatatatcggcatttgatgttacctaggttgagttagtgttgagctcacggaatttattgtatgagtagtgatttgtaagaattgttagttagctcgttcaagtaatagttgtctacacaacgtcaaaataagaaaatggttgtaacattatccgtgattttcttactactatcaatattcatgatttgactctgctgcagctacgtatcgcctgaaaaccagttagtgttaaggaatactctgagtaggacaactcatgtagtaaaagttatatgttcgttgggttctttcgacacggatctgagttgaccaacgtctcatttgaggtctgtactctaatgatgagaaatatgtatcttattcttgcagcttgtcagtactttcagaatcatggtgtgtatggtagaatgactcttataacaaacttcgacatgataataaccccccgtttctacttctagagaagaaaagtattgacatgagcgttcccagcacaagagctaaagaagtttccaattttttatttctgaatgacatgtgtctccttgcggataaattaccaaccgtaattcatagaagcctgggaaaacagataggtctaattaacttaagagagtaaatcttggaatcattcagtaataactataaacttacgttagaacttcttcggtgaatttttacagttatcaattaagaaatttgaagtaaatcaattaaggatttagtcgcgctatccgataatttccaaattaaaacatattgttctatgaggtacgaattacgaacaccttaacattagggaaacttagatagttgtacaaagtaacgtataacaagtatcgcgtatggtatttgttctgaatcgaccaaggacacaatcaaattccgatttgtatcttcaacaaacttgtacccaacccccgaagtttactagcttctcagatatcatagagcttgtggttcatcgcgtccgatatcaaactttgtcatgataaagttttcccctcgggaataccagagaaaatgactactgaattgtgcaatccttgcactttaactaaggaagctaccaatatttagtttttaagtcttacgtctgacttcgtagatagattgccatacatagagcttatgaatcagcgaaaagtatgaggcgcttttaagtatggcgagtaagtgatttaacgcttcggatatgactatatacttaaatttgatctcgtcccgagaattttaaacctcaacatttataaattataaggttagccaaaaaagcacgtggtggcgtccatcgactgttcccaaactgtagctctttgttctgtcaagatccaaggattagatagtaaaagtcgaaatctttatattcggttcgatgtactacgttattcgcgactgttctgtcatgatagttttttatatagtcctaataaaaggagtttttaaagtaaatgacatttcagtagtaaaagtttaagagctttttgttctgccagacgttctgatagttgaggaaaacgtgtggtcagctaataacttgtggtatggtgtctgctatcgagtccctctaatgactggatagttagacttgcccttggaaaacatagcaagaccttgcctctctattgatattacggcgaatgttggagagacagcagcgattgcaaatatcagatcagagtaatattaacataggataactccgtaactgattatgaccttttctaaactttacttgattaaatatgctgtctttggcacatggatgatttagagaaattacattcaagactgattaagcatgaaacaattcttgaatgtaaaattgttatctcctatattcaaaatataaatactagataactacaggaattccgacgttaaatacattactccattataaacgccattcaggatcacgttaccgtcataaaatgaaaacatgatttcttctccactgcactcacgtcaatagtaattactcctataacctttctaagaatccggaggtggaaatctgtcacaaatgagaatatatttcctcgataatcattatagaacgcttctaagtttttccactcggttaaaccggctaggcttttctgcctgaagtttcaatggactgctgtcaacacccaggcattgttttagaagaattattcgagggcattcacaaccaacttgtcgggactagccaaactggtcatcaagtttatatagtgaaatactgaaaacccagtcccacactatggaatgtctttaattctggcaggtaattaaagacaacgtaaatataacggatataaacagaaaaataggcgaatatatctatttatattgtatcgataaatagctttgtggaggcatgtgtcatgctagcctacagagtactctaattatgcatatggttcacaagacactcgttgttttcgaatttaccctttatgtgacggtttttaagcacacttatgctcaacatcgtttaaaccagactgatactaaatttataaagtccgccatacagacgaaagtacatggagattatcgagcaatctatctgatcgacgaccatttgtgtgatactagagccgagaggtaactatgatgctgctaataatctctcggtcgttgttaacgtttatagtctagtttcattataatcgtatgttattcagggattgattaatactggaaaacatttcagttaaagtaatatatacgacagagatcgtgtacctattaaacctctttaatctaagttcagactaattggtaatttgtctagaacttagattttattactaaaggatgcacgttttatttaggagtaaacgaacatccaacagtatgtacaatcgtatgagaaaggacaaatctgaagacgatattagagggagtccaacaagtttgtgatgattcacgtaaggaaatcgaaatgtaagattattcgtcaatggaggtataagacaacacaccaagtaattatacgcgacgagttttcatgttgacgatccctgagactatatcatacaaaattgacccaaataataaactcgttccaatagttgaagtgttgattaacacattgagacaagttgtccgtactttaatcatcaaagttttggactgacctataaatgaaatattcgcgttgtcttcagtttaagaagtgatattattttcggtttcaagcctatgtggagagatacaggaaataggtaaactataactaatataaatatacgcagacgaagcctgttaactttaccaaatccaaatagcgggagacactaaacttacaagaaatgtacggtaagacagggaaacagggtttgaagtttggaggtacaaaatcttaatccttcacaactgaatcaacatttacattcggttacgttcggggtttgtagtagtaattgttgaggtaattttaattgcacttacagacgtggatttggtgaaacattatgtggtagattcatatttccgaatcttaatagacgattttatgatggtgatcgtggtttcttttcaaggtttggtggacgaaaatgaaaaaatcacaatttaacgtttcatattcatcacaatccgaaatcgagatggagagaaagtttgactaaactttgttacagtatttttgaaggcaatcaacctggaactttggatttcatcaagtaaacacccatatttagcgaaaatgcaagctaactgcgaactaacaaggtaactctttttcgatttcaaaatatggtcagtagcaatatgttaagtgatccattttggaggggtggggatttgttcaatgaatgaggcaataaaccaccgcaacctctgtaattgacgagaaacttgtataaggtcatcaaaaagaatagatgaacataaagattgaatacggctgggtgaggttaattcagatttcccaaattatgtagatgaaaagatggtaagtttattgataggtaaaaaatcaagagagggtaataaagaagaaagaataatcaaaagatagagcatgcaaacattacatggtagtattgttataggcggtatattggtaaatgacgatccttgacttagttttttacatcgaacggttgcaaatcctagcatacttgatattaatagtagatactgaaatatatctgagtatatcaagggaaatcgagatgtaacaataagtcgaggaaattaaggtcaatttagtgcttatcatagaaataactacttaagcccttaacgaactaactcaaattaacgaggtagaggttattctgaattgtacgaacgtagtcgaagtttgttaccaagggtaaagccaaaacaaaacgatttgacaagagaatctattccatgtagtagtgcgtttgtacgacgttctattcgatgtaaatcattaggacgagggtttgaagcaactcggaaagatggtcggttagaatttaaaagtactgaacggaattaacgaagttggctactacctaatagtctttgcttaggatttagtagttcgcaattgggtcaaagtggtcgctttggtcgtcgacgtcaagactcaacaagtcatttaccgctgtacgaaccatctcatttaacaggttctcaaccaaatagcggtaggagtagaaagcacttaccatcgtacgaactttgacaacgaaaggttcaaaggtaaccaaggcgtagtagtgagttaggtcaatgtataaaaactccctttcttattttgagtcgtcaatgtagtcgagaaagtgtccaagcaaaacgtaacgaaacggttgagtaaggacttgcacactatgcccttgcgggtttacctgcttgacgtagtcctgccacttattatccgtgattgttacctaatggacaacctaatcgttagcttaaagaagatgcacttagtgccattattattagacaagatagtccgttctttagtcgaagttcttgttgtaataacaaaagtagagcagtattttgacgtatagggagacagtcattaggtcattaacccagttactaaggacaacgtaaccatcgaagttattgaacttcaggtacctaacagtaaaagagtcacataatgcctctgactgcgtgcctagggtatatttgattagtatcaaatagactaaaatgaatttttacatcgaagcgaaaatgggtgcgtggactaatcaggagcaaacgaaaaatcttgacctgtttgatgtctcgtaatattcttagagatgaacgaaatgtttcatgacctagaaaaaagtcgttctacaaaatagatttatgttactctcttcataaagaattcggtgtaccgaaagaacaaagcgagtttaggtagtaaccgttgactatgggggtaaagtatcactcaagaagcagactcagtaacacacggtttagctgattgtttatcgtttaggtcatatagagacctttaatatctgtatgtctagctttaaaatttactttagtgcgcaaatttgagtcgaaataaaatcaccagtacccaaaaccaaggattacgatccgaaatttcatggacacagatatttgagatcaacatttgattcgttgacgtatttatgttgattcggttagcgagagttacaaagttagtaatagaaagaaagaggaaataataatcaaaagattaagcatgcaaacattaagaggacacatatgtattggtggcatttgcgttaggttaacgtctcgtaagacggtgaagctgcttaaactattcggactaaaatagtgaaatttatgatgtgtgacccgttatgctccatttcgatcagtgggttattactagtagtcgattgcattgtcattttccgagtgatttagcgtgacagtcgcagagaacccataaaatgtaatcgtagtccatctaatcatacttaaaaatgaaggtctccttttacccacgcacctgtttactcgtcgtttacgtggttaggtcgcttggtagcatatctgttaccgaagacacgacagtaaattgtcaagcaaacactgcgccttcttcggtcgcataaagaagtgaaccataacgttctcctacttaactccgcaacgaaaaagagctattgctaatccaatttatctcatgaaattataattatatagaccgaaattttaaatcaaatcacataattaggctcagctttattttagtggtcatgggttttagtaccattcgttcaacatgaagtggcttatgttcgcggagtagtagcgcgtaaaagtgtaggtacgcgagctatcgtgcggtgtagcatcgcagtcaaagcttgcgtaggtagcgttgcaatctcctgtactaaagacatgcaactgccagcttgtactgttggcgaagaaagttcagtggatgttactaaccgcgtttaacgcgtggacacggcggcagttgagccaatcgattacgaaacaagctatgctaatgttgaccatttggctcttcgaccagcagtcagccgcttctttacctgccaacgttgttcataacaggcaaaaccagaaagtcgcataggttggtcaactttcgcagaaccaactgttactgcgatcttcagcttgccttttgtcccagattaacgtgtaattattaaacaaagttcggcagttccagtcgctatcgacaaaaccgaaaccacaagttctgtaattacgcgttcggcaaagcgcaatgcgccctaatacttaatttttttttcgtaaggaacaacggatcttaatgaatggcgccaaatggtatggaagctaatagcgcgggtgagagggtaattagccatcttcaccaatataacgctatcaggttatactataagattccataatgcaactatttataaaatgtcttaatggtatccgcaacttgtgatgtgtctactatgcttaaatgcatatctcgcttaataacttttcaatataagagcattaattgtaaatcaggttgagataatcatgtcgtcacggaacttattgtaagagtaataatttaaaagagatgttagtttgctggttcacgtaaaagttcctcacactacctctaaataagtaaacggttgtaacattatccctgattttcttactactattaatactcatgacataattctactacagctttgtttcgccagaataccagttagtataaagaagagctcaaagcaggtcaactcgcattgtgaaagttacatgaacgttcggtactaccgacacgaacctcagttaacgtacatcttactagaggtctgtggccttgtgatcaaaaatatgaatttcgtatttgctgcttgtcagtactttcagaatcatgatctgcatggtaaaaagacacttattatgaagttcgacatgataataacgcgacgaatctacatcatgacaagaatagtataaacaaaactgttgacagcagaagtgtcaaagaagtttgtaaattattatttgcgaaaaacatctgtctccatgggggataatcaccgacgccattttatagaagcctagggaaacagattggtttaattagcttaagaaagtaaattctggaattatactgtagtaatcattaatttacggtgaaagttttatggcgaatttttacaaattcaaactaggtgatttcaacaaattttattaacgatttagacgcactatcccttaaattacaaattaaaaaataacgttccttgatggc

SEQ ID NO: 342 - DNA, 16122 bp, Artificial Sequence
  SIRV4
acttattgtttgctaatactacattatcctcacaataccgaatgtagttggctctctaaaaatcctcatagttgcaacggggagccgagattattgagtgatcaccagtagctgtactattatataagctattaaagattgatcaaagtaaacataccgcccgtattatataaatcatactcagacgaacattgctacaatccgtattcgcaccaagttatgagcgcgtatttcccattaaagcttttgtcgctcacaaaccacagggtttaccaatcattcacgtgggacatgcgatcgtactgccaacgatggaatatgggtaagaagttatctgtctttcttctaagagagcaattaaaaggttgaagaaatgcaatatatatgcaagggaaattaatggacgatcttaattcctgtaaggtagcagattgtgactcaaagatgactaaataatattgttgtacatctgcctaatccgttctgggctttacgaccaacagtaaccgagacctataaaaaagagcttgatacggacgcgcaactatacttaggatacctagatgtccgtcttttccattcagccaaattctgttacccttttcaatctacggatctcataattaatagctcgtttatagaagagtatacactatctaagggtggggggccaacgatccttccaatcagaacatcaaagatatctggactgacgttttctcctctcaaggactatagaaaaaaaatcccgctgcactaggatctaccgctaagtttacctggttgtaaatcttgcagtgttaagaagatcaatggatcataaaaataaaacgtggaccctttagtaacgaaatctaagatctagacatatttccaactagtctgaacttagattaaacaggtttaataggtacacgaactctgtcgtatataatactttaagtgaaatgttttccagtgttgatcaatccctgaatagcaaacgattataatgagactggtgtagcatagcaactgttctgaatgtgatattcggtcaggccacgttgacacttaccaaagcaagacagaaggaagttgacgggacaatagggaagattggcaaagggatttaaacatagtccagttcgcgtggtgaatgacagattgctactgttaccattggcgatactacgttggcgactttacttgcctcggtagcgacagaacaagtgtcgtctacgcaacgaacaaccagcgtgttagctgcaatgtcccctgtagaagaccctcttctttctcttctgaatgatgtagctgtggatagagcgtctcccacgttagggtctagcaaccctccggtggtggtttcgagaacgatataaaaagttcccgtacagattgatgggttagtgttctccctgggctgtcgtctgcatgacggaccttatagtagtacagtcgctttaatttaaggatcgtggcccagtcagtggattacgttgaccatgagtctggctgttcttggttcaccattagctgtggtgacaataacgggcattgtggcaacgatacgtcgtactgcaagtcccactgtaactaagacaattcggattcgaccgatacttggtctggttcgttaacttcgcgtaccttctgctttaccagcaggtcgtcaacgacgagccaccgtaacgagtgtggtttcggttcgcttggttgggtgcccaatttccagtaccgaagaggtaattgcaacttcaattgcttagttgacgtgacctttcgggtgtcatggactaccgacggtatctcatacgtgacctcgttgttgacctcgttcttcatctgcacagactacaacgttaggactacggaaccagtgtgaagttgacggacgcgctaggttatcatcttttatagggaggaggccggtagaggactttacggtatataagcccaatgactaccgcgagtggtcccgtcaaaataggtcggagtatccacaaataaggctccaataacaatggctgactcttggcagcacagcgtcgaaacttggggcacagaggcctaacagactgaaccaagtggaaaaactaaggagcatcccaatatgattgactgtgaataagattttcattcgtgggggatatccgtcaccagttactcaaaaccgtaataggaataatgactactaaaatggggacagcgtacataatgtcatgctcgaataatatggtggtatggtgatctagaacacctcctatagtttacagatgcggtttattggattggttacaacggcaaaggcggagaccactccaactgtcggaagagtacctcttcaaattgccattccaattgctcgtcatggactttccactcttagacgacccgatgaagctagaagtctgacactgaccatgcttgtggcaatcgttgttcatgtagccactttgactcgacgttcacgaacatacgatggttagttcttctactatactaatggcttgttttcgcagaatctgtatttagacgtaacaatggaaataatctttttggacattgatctagattctttaataataggtttatttaccaagttgacgtttcacaagttgttttaaaccgactttttttgatgtgtttgtagttattacagctgaaagatgacgcgtactagagccgcggcgtgtcaaactttgcatgccagtcgcgacagcgagtcaggttaagactagcctatgttaatttgcacatgctaacataagtcaataactttaaccgtcttctttatatgttgttgctgcatgattatctgtaaccactatctagttaataatatggttgtaacagtgtctgttacagtcaccatggattttgttgttatggatttggctgttgacacagctgtagcctatattacgttttttgtttccacggttgttattaatagctaagacttagaaggagcggcgtttgtgtatacggcggtggttatggtggtggttatggcggcggtggcggcggcggagtttgtttgaatagaagctgctatggaggaggcggcagcggaggaggcggtggcagtaatggtaattatcttctatatcattatggtaggtcatttctagcgctaatatgttgcagctgagccgttcaaaattttctaggtgcatggcttaactaccttgtttatgtctttccttaatttaatttttttcatagttttgggcggctaccgccaagctatcatttatggcaatggcggcggcggtcaggatgacgtttctaaaatgttgctgcgtatcggcaagttggctcaggacatcaaagcagtcttagccttttgcccacctggctgctgcttgttgtcgtcgctcggtcgtcgcttaattttgttatacatgctagaaacaggttatattgtaacctgtcaagtacctattttttaataggaaacagatgacttcgtgttctgtgtaattatagttattttttagttaatttagttgccgaaagcttacgtgtttgtgttgttcaaagacaatttgatgtttattaataacttctattgaactatgttgtttgcatactattaggaaacctgtttaggctactacagcttgaagttaacaggctatttttaaatgttcttaagtaataccgccaccttctaaactgtaagttttttgtcatgctatttcgcaatcgattacaccacagccgtaatccttggtttggctggttagtttttaatgttcttaacgctagcttaaatctattttaatactcaatgtttaactgctacagttgacttagcgttcaaatttaccgtgtccaagttgttgactgggggcgagttgtccgccgtaacgcgttagtcgtccgataccgccgtttgaacgtccgggcagtttaacaggacgttgtcagaatgggccaataagtcgtccaactttgcgtttgaaagctgggccgattggcaaggcacaaactgcactggggccgcttgcacccgtaacagtttccgaaaaaccacttccattgccgccgatagtttttattggtgacatggcttcgccaccgggaatgactgaagccgggccgattggaacaagctatgtcgcgtcgtgtcccggctttgagtgcgttagcaccggattgtctggctcagttcagcttttggatacctcatcgggttatactaactgacacttattctttaaataaggatcccttattgggagtggtaagtgaggtttgggactatccttatttctaatgatcttacccctttcgcatgaataacagtacgagcttactttacgaggatatcacttgatcaagtggaggatactcttccaattcttgaacaggacctagagagttgaatgtattagatgggcgtacgcattatgtgcccagttgtataattgtgtgttttcaaggaaggaagtatgcgtcaattcgttcagtatcgacatagggtatttggaaagttttagtgacataggccaatagattctagatctccttacccatcagtaaataccattatagagtcaattcagatctacgccatttaacacacaacgccgaggataaaagggctgaaattgacagtctactattttgttcatgtgtgaacaattaacaatattcgaatacacgttgatgcgatagtgctctggccaggccgcccacttcgtatattttctttgagtagtgcaggcgtattaatatagcatgtagccaggaccttagcatgaagcgatgattaaaatgtacgcacgccacgttgggatgtatgtgctatagacttttagtgttacccgaaacatagtccatcgattttgccataagacttcggcacgaagttaagtgatttcacacctacaagagaaatgtgccgaatctatgataatatcaccgttcgttgtattaatcaataatggtagcggctgcatattatcaaatgaaggagcgacacccggggaggagttcacggtggatatcccgtaccactatattaattattccgtaatcctcgtcttacctttttgcttttatctggacgtgtttaacattgatgtttgaccagtctttgcaaaggtttatattgtcgtagacgttgttcagcactataatcgttaggtcattaacatctgatgtctagtgctaaagacatattattatgtggttttctacaaccttatatactaatacagctgtatttcttaccatgatgacgtataccttttacaaccctttttgctaaattcggaagtttaccataaaacatacgactttcatggaattttccgttgcaacgatgtagacttcgtcggtgtttatcattacagtactgaggatatggtccaaatcttttacctataaaatatttaagacgtttattacgacttgcattactgttagtttgtaaacaaggaggatttcgcataagtcgttgctttaatttagtttggttatggtgggttaatcgacggatacatctaatatacccaatattaataaaacctcttgtttttacacgtggcgttcgttacggttttaaatactaaccgaaacatttgtaagcattactgctgttaagtaatgattgacgttttaccctgtaaaattatttttgagcttatgtaaacagaccatacgttcgatgttctcttacccaacgttcttgcactgcatatggtggtgttaccaagtgtagcgttatgtgagttaaggcaatggttttatatttagatgttcctaataatgcttgcccattatgccgttttgatggttgtttctctggtgtttacgttagattacatccgtaagatggttacacctcactcctacaacggaaatatgaccaaagtatcagaacaacatggtccgcagaaagaatcgatcgtgataaaggttggatcttgacagaacaaagagccacactctgggagcagtcgacggacgccaccacgtgcattttcggctaaccttataatctataaatgttgaggtttacagttctcggggcgagatcaaacttaagtatatagtcgtatccgaagcgttagatcacttactcgccatgcttgaaagcgcctcatgcttttcgctgattcattagctctatgtatggcaatctaagtacgaagtctgtcgtaaggcttaaaaactaaatattggtagctaccttagttaaggtgcaaggattgcacaattcagtaggcgttttctctgctattcccgagcgggaagctttatcaagacaaagcttgatatcccacgggatgaaccagaagctctatgatatctcagaagctactaaacttcgggggttgggtacaagttagttgaacatacaaatgggaatttgattgtgtccttggtcgattctgaacaaatcgtagtgaacccgtgcaaagtatacatattaattcatacggcgtctcaaagaggcaatggcttgacttgagctggattacagattatgagtaaccgcaagatagagtaaacactgtaatccatgcttaattgagaccacttaaagatgctgataccattttcaaaacacgatggtttgttgacaattatttgtacaccgacgcatcttgcggttcttggtcgaccctacttacggtataaatgaagcacgtttcatccagactcatccatcgtagctccaaatacggattcaacttggcgtttatatccagaaaagggccctagaggtgatagactcttaagtctttggactaccatgggatatgtttcacgtatcgaaatagtaaccattattctgcgtttgctttcatgcaagtgaggatgaagcctttgtattggtttcttaatcctcctataccacgcgtgtatctttcccggcccttcattgaatccggaagtgtcttgttactcaatgtcaaacccttgtcagcctcttgcggtgatgcacgaaaaaaccgaatggaatataaaatattaactactcctaattttaagtgccctcttctagattggattcatatatcaatatagacttcgcaagctagtgaatgaggggtatgaatttatccggaataacaaaagggactgagtattcgagatacgaaccgttagatagatgctccagtctgcatagtgaatttttgatttttaaccattgaaggaatcaacttcacgacccttacgagttaagtcatcagaagaagagaccatcagcgctccccccttgaaatagtacagcttcaaacaatagcctgagtaagttggtatccgaggtactataaacttctcgaccatttgatgcccccaacctatgtttaaagaactattatctttagccttaagctaacacaggaaccagctgagtcttgcctagcctcacttgggctggttacatatataaaataatgtatgccgcagaatctgtcccttagcgaattgtagttgaccaaaagtctattactcattggcgttgtgtcacttttgtgtcaataggtatgatcaatctcttggaaatttttacgacgatggtaaaagattagaactactaaacaactgttaataatcatgtcgctccgtagattgccaagaatcagttgggatgagtacgttatttacgacgtacaagctgcgactgagttggactatgattaataagaggttgattacatcctgattgcatggactgcgatcacgttttgtaagttcactgggactgttacgcttaactgctcggaattcgagaaaatatacgactgttcgtaagagcgctttgatcgaacacgatcataacagggcacacatgataatcatcacttttttagtccctattacagagcagccgagtgaatgtatgtctatcgctcactatactatttgcgtgttatagggtaacctacgaaagtgaaactacttcgtattgctcgtgtttttaattcgtctccgattaatacactatactaaattttaaagccagatatatcaatattaaactactcaatttaacctaatcctcaaacgttctactaaaccgtgtcaatcagtgtctgcttcctgaatgaaactttttcgccaaagtcaacagttagaacctaaagtcgctttcgtccttagctacatcgatttctttatacaggcagtaacgtagatccattccgtagaacggtttttcacttggacatgaaacatttctttgatctccaggagaaatatgagaaactaaacacgtcgagtaaatacgtatgaccattcctcttgatcgatccaataagtctctaatgtgtccagagttccaacttcttcaacatacgctctaaatatcaaatccaacagcaaatggtaaacaatgaagacggtgttgttcaagacatcgtttgctccactaaaataaagctgagtctaatcgcgtgatttgatttaaaatttcgatctgtatgactataatttcgagagataaactggattagctatttgctagacgatttggcacagaatgacacagacgaagaactcactatgaaatggcggtttcagttgccaatgatggatttcagcgaaactaggaagcgatgtggcttaagaaatacctctctcattgcatttagataaagcatcttgctgaaaagagaaccaccttgtcaccttccacgtatgcttttgttgtactggttattattgcaactttacctttgtgttccactccgtagtggccatcgtcctcctagtcgtgttcaactaggtgcatgtcctccctttcgtcggccaccttaccctcgtccacctcgtcgtttgctacctgcagtcctgtataaatcacctcgacgagtcggattagttgtagtagttaatactatacccttttcgatagtgaaatgtcattggttacctaatggtctaatatctgtgaaacaccgttcacctttgttaatgtaacgggttgtttctaaatttgtatatgtgccttatggaacccttgcgaataattacatacattcctagcattatatcctagcctgttagaacagaagcaccattcccatgtaaacccagcgtcttcatcacattgaatactcccaccgattaatattgtttttaatatatgatgactcgaccttctaacacaaattttctactgattatttataacaatatgtaccaggattagccaaggtgccgagcgcccgtggttttgggtactggtgattttatttcgactcaaatctgcgcactaaagtgaattctaaagttagacatgcagatattataggtctctatatgacgtagacgataatcaaatagctagaccgtatgttactgagtctgcttcttgagtgataccttagccccctagtccacggttactagcaaggctagtcttgttctttcgatacaccggactgcttatgaagagagtaacataaatctattttgtagagcgaccttatcctaggtcatgaaacatttcgttcatctctaagaatattacaagacatcaagtagcccaagatttttcgtttgctcctgattaatccacgcacccgttttcggatcggtgtaaagattcatcttagtctatttgatactatccaaatataccctaggcacgcggtcagacgcattatgagactctcttactgttaggttaggtgttgttcgatactgggtgtctgccaatacctcatattgcccacagtgccgaatttaaatcggtcaaattaggtcctcaaagttgtaacgccatccccacattgttgggtggtgaccggtaggtgtacaataatataaggtattgaaaattgaattaaatatactttgcgcccgttctacatgaaacaaactcagtcgaacgatgcaagaatctgcattcgaaccaagttatgagcgcgaactcctatttaaagtttttgtcgctcagaaacctgagggtttaacaacgttttacgtgggacatgcgaaccccttgccaatgtcgaaatataggaatgaacaaatctgtcttcgtgctaagggtgcaattaggacgctgaagtaatgtaacttatatgcaaggcaaattatagcaaaaactaaattccagtaaggtggaagattgtgatttaaagatgactaataaatattgttgtacatcctcctaatcggttctgcggtttacgagcaccagaatccaagacctctaaaatagagctaagtttagacgcgcgattatacttaagatatcaagctgttcgtctattgtatccagggatattctgtatcccttatcaatctatcgatctcgtatacaatgactcatttatagaactcagtatagaatctaaggatcgggcgccaacgatccttccgatcagaacatgaaagctatgtggtctgacgattacttctctcaatgtctttagaaaaaaaatcccgctgcaataggatccagcacttagtaaagcaggttgtgaatcttgtaatgttttgaagatcattggatcttaaaaaccaaacgtggaccgattagaaacgtaagctaagatctagccacatttctaactagtctcaggtaaattataataggtttatatggtacgcgtaccccgttctgcataatactttaagagaaaggcaatccaatgttgatcaagctctgaattacaaacgattatgatgtaataggggtgttatggcttacatcaagccagagatttttaggagtatcaacgttgcccctcggctctaataactcactagtggtcatcgacatgataatatattcgataatttctaactagtttcatttgtatggcgggcataatatatttagtttgagtctgcttgcaacgatgttaggcataagcctggttcaatactcgcgcttaaagggtaatttcgaaaacagcgagtgtttggtgtcccaaatggttactaagtgcaccctgtacgctagcatgacggttgctactttatacccattcttcaatagacagaaagaagattctctcgttaattttccaacttctttacgttgtatatacgttccctttaatttcctgctagaattaaggacattccatcgtctaacactgagtttctactgatttattataacaacatgtaggcggattaggcaagacccgaaatgctggttgtctttggctctggatattttttctcgaactatgcctgcgcgttgatatgaatcctatggatctacaggcagaaaagataagtcggtttaagacaatgggaaaagttagatacctagagtattaattatcgagcaaatatcttctcatatatgatagattcccaccccccggttgctaggaaggttagtcttgtagtttccatagacctgactgctaaagaggagagttcctgatatcttttttttagggcgacgtgatcctagatggcgattcaaatggaccaacatttagaacgtcacaattcttctagttacctagtatttttattttgcacctgggaaatcattgcttttgattctagatctgtgtaaaggttgatcagacttgaatcaaatttgtccaaattatccatgtgcatgagacagcatatattatgaaattcacttttcaaaaggtcacaactagttggggacttattgtttgctaatattacattgtcctcacattagcgattgtagctggctctctaaaaatcgtcgtagtaccaatggggagccgagatcattgagtgattaccagcagctagactatctaacgagctattagaggttgatcaaagcagacataccgcctgaaatatataaatcatagtcagaccaacattgctacaactcgtattcgcaccaacttttggccgcgtatttcccatttaagcttttgttgctcacagaacacttggtatacctatcaatctcatgggacatgcgatcgtactgtgtacggaggtgtttcggtaagaagctatgtcacttttatctaagtaagcggataaaaagacaaaaaaacgcaatatatatgcaagggaaattaatggacggtcttaattcctgtaaggtaacacaccgtgacccaaaagtcattaagtgatataattgtacatctggccaatccgttctgggctcttcaaccaacagtaacgggggcttattaagaagattttgatacggacgcgcaactgtcgtcaggtaactttgaagtccgtcttttcggatcggccaaattcgctcacctttttgaatcttcggatgtcataactaatagctcgtttatagaagagtatacactgtctaagggtggagggccaagaatccttccaattaccacattaaagatatctgcactgacgtctcctcttctcaaggacaaaagtaaaaaagtgccattgcactaggacttaccgcaaagattacctcgttgcatatattgcagccttaaggacatcaatggatcataaaaataaaacatgcatcctctactgttaaaatctaagttctagacaaactaccaattagtctgaacttacattaaagagatttagtaggtacacggtctctgtcgtataaattactttaactgaaatgttttccagtattagtcaatccctgaatagcatacaattataatgagactagactataaacgttagcgacgacagagaggttgttagcggcatcatagttacctctccgctccagtaccacacaaatggtcgccgatcagatagattggtcggtaatctccgtgagctatcgtctgcatggcggactttatagatctagtatcagtctggtttaaatgatgctgagcattagtgtgcttaaaaaccgtcacataaagcgtatattcgaaaacaacgagtgtcctgtgaaccatatgcataactagagtactccgcagactagtatgacacatggctccgcgaggctatttatcgatacaatatgaatagatatattcggctatttttctgtttatatccgtaatatttacgttgtttttaattgcttgccagagttaaagacgttccatagcgtggaaccgggttctgggtttttcgctatataagcctgatgactacttcggctagtcccgacaagttagttctgaatgccctcgaataatactcctaaaacaatgcctggctgttggcagcagtgcattgaaacttcaggcagaaaggcctagccggcttaaccaagtggaaaaacttagaagcgtcctattatgattatcggggaaatacattctcatttgtgacggatttccacctccggatactcagaaaggttataggaataattactattgaggtgagtacagtggagatgatgtcatgtttacattatatggcggtaacgtgatcctgaatgccgcttatgacagagtaatgtatttaacgtcggagtccctgtagttatctagtatttatatctcgaatacaggagataacattttaacactcaagaattgtttcatgcataatcagtcttgaatgtgattactctaatccatcaacgtgtcaaagacagtatatctaatcaagtaaagtctagaaaaaggcataatcagttacggagttatcccatcttaatattactctgatgtaatatttgcagtcgctgctgtctctccaacattcgccgtaacatcaatagagaggcaagctcttgctatgtttttcaagggcatgtctaactatccaataccggttcttattagaacttcttttacacaatttagtaaggcatatgccttacccattttcctttagtttactttttctaacccgatgttaattcgcataattagcacgtgcacgtcgttcttctcttttagttcttttagttgttctgtatctgcacgtacctgtgcaacgtccgcttttattacttggtctagtgcttcgtttaaaccgtctaaaaggcctaaaggaggttctgaaacatcgacttcgtcctggttcaccttggcctcaataatggtagcggctgcttatcatcaaatgaaggagggacacccggggaggactttacggtggatatcccgtacaacttcggctaatcatgttatctaaataagttggggtttgcagttgtgagggccgaatcagattcgactatacagcgcagttcagagccctaactcacgtaatcgtggcctaacagaccgagtcaagctgataacccatcgagtagctcaatatgagcgactgtgaataagaaatttattgcaaggcaataatcctgatcattgactccaaactttgataaggatgaagattagcacaattgagaaagcgtacttactgtcatgctcgaatgaaatgctctattaaagaataggttgacgtcctacgagaaggttaagaacttctcctgcatctcacaacctacataatcttcgggcatgggtaatagacgggtgaacatataaatacacaaaagtttcttccttcatacgtagctaagcaagtcatagctataccccacaaacctttcataatcactgtatcgggttatctaagagctagtggcatggctagtcatctatggtaatatgtcagttaagtcaagatgcggtaaattgtgtattgcggctcctattgtcccgacttaaactgtctgaccgtatcagattaaccacctgatcctaattgcctattgacagaacaaagagccacactcagggagcagtcgacggacgccaccacgtgcattttcggctaatcttataatctataaatgttgaggtttacagttctcggggcgagatcaaatttaagtatatagtcctgtccgaagccttaattcacatattcgccacgcttgaaagcgcgtcatgcttttcgctgattcactagctctatgtgtggcaatctaagtaggaagtctgtcgcaaggcttaaaaactaaatattggtagctaccttagttaaggtacaaggattgcacaccacggagcataagtaaaaggatttgtattaatagaaccaggaccatcaccattcaagttacacggtggtcaactacttctgctgcgttatcgttctgtattcctaaatcgaatggttgttcgacttttagtatttctgtataagttcaacctgttttgacgctctctgcttaagaagtcaagtaaatatgtatcacctttcaccatctaagtgaggatgtagcctttgtattggtttcttaatcctgttataccaggcgtgtatctttcctagcgctttattcaacctggaactgtcttgttactcaatgtcaaacccttgtcagccacttgcggtggtgcacgaaaaaaccgattggaatattaaatattaacaactccaaattttaagagccctgctctagtttggattcatatatcagtatagacttcgcaatctagtgaatgagcggtatgaattttcgcggaatatgaaaagcgactgagtattcgagatacaaaccgttagatagatgctccagtctgcattctgaatttttgatttttaaccatcgaaggaatcaatttcacgaccctaacgagttaagtcatcagaagaagagaccatcagggctccccccttgaaatagtacagcttcaaactatagcctgcgcaacttggtatccgaggtactatagacttctcgatcatttgaagcccccaacccatgttcaaagaactattatgtttagccttaagctaacacaggaaccagctgagtcttgcctagcgtcacttgggcacgttacatatataaaataatgtatgccgcagagtctgtcccttaccgaactgtagttgacctaaagtctattactcattggcgttgtatcacttttgtgtcaataggtatgatcaatctcttggaaatttttacgaccatggtaaaagattagaactactaaacaactgttaataatcatgtcgctccgtagattgccaagaatcagttgggatgaatacgttatttacatcgtacaaactgcgtctgagtaggtaccatcgtagtttatgcctatgttggaccgcaaatatacgtcttttgccgggatccccactatctgtgaaatgtgaaacctgttggttacctatacaaaatacatagctatatcattggtaataatatgttaacggaagatcgttcactctttcttcggaaagata

SEQ ID NO: 343 - DNA, 14606 bp, Artificial Sequence
  SIRV5
cctagggtattttacgttagcatcaggtggactaacatgaatctttactcccaagcgaaaacgggtgcgtggactagcgaggagcaaacgaaaattcttggcctgcttggtgtctcgtatttctcttagagatcgacgaaatgtttcatgaccaagggaaaggtcgccctacaaaatagatttgcgttactctctccataaggagtccggtgtagcgaaggatcaaggcgaccctaggtagcaaccgccggcttcggcggtaaggtatcactcaagaagcagacacagtaagacacggtctagctgattgtttatcggctaggtcaaatagagagctttgatatctgcatgtctagctttagaattcagtttagtgcgctgatctgagtcgagataaaatcaccagtacccaaaaccaggggggctcgccacgttggctaatcctggtacattttgtaatcaatattcagtagaaaatttgtgttagaaggacgagtcaccatgtaccaatagcaataacgatcggtcggactattcattgtggtgatgacgctgggtttacatgggaaaggtgcttgtgtcccgacaggctaggatataatgctgaggcctttccccaaacgttcagcgtgggatttgctacaacttctgagtcctacatgtacgtgttcatgttatgtatgcacaaggccgagaataggacgtagccttcgagttagtacgtagcgtggtcgcataagcacagtagatcctccccgcgcatcctatttattaagttaattctaaagcaatacgatcatatgtggatgggcagtggccggttgttacacgtctaccgcggtgctgaatgaccgggactaaagaggcgaagattatggtgtgtgacccgttatgctcgagttcggtcagtgcgtcattgcaagtagtcgattgctttctcaatctccgagcgatttagcgtgacagccccagggaacccataaaatgtgatcgcagtccaggaccgaagcatactgcaagacttgtaggcccatgaattacccgcttaggcaatgggtagacctttccttgccgcgtggaacaaaccgccatgagtgttttacgtttacggtcggcgaccggagtcacagcgcgaccaacggggccagggtgttaccctgatgaatattcaacggaattgctataggccttgaacgctacacggacgatacgaaattatgtatagaccgggtcatcaaaaggttatactcttgtagttaacatgtagcccggccctattagtacagtagtgccttgaatgacattctctttattaaattttctctacagctaaacgatcaagtgcatttccacagagcgcgatggagattcattcactcggcagctctgtaatagggactaaaaaagtgatgataatcatgagtgccgcgttatggtggtgtcggaacagagcggtcttacggccagtcgtataccttctcgagttccgtccagttaagcgtgacagtcccagtgtacccacaaaccgtgatggctgtgcttggagtcaatcgcaagtaggatggtctccagacaccggggcaccagttttcacgccgaaagcataaacgacgagcagatatgaaagtgttagaactggacgtgccgtttctctgcgaaaaatacctcgagctgtagcgttgttgcgctgcctagatgcagtgttgctcatatcacatttgcttcaacgactgccgccttcgctgtatccctagacacttaacaataagcgctttttgtaggcaggggcaccccctatcagtgactgcgccaaaatatcttcggatccccttgtccaatcaaattcatcgaattcttacatttaagaccctaatatcacatcattagtgattaattgccactgccaaaattctgtctagaaataggaggaagccttttagccatcgctatgccgccgctcaaacgcgccgggtgcaaaagcccagagcaaaggcccataggcttttccatcggcacgcgaccgattccatcaagtatagccacggtcgtaacttcgacggcggcaatagtttatggcgctaacacctttccatcgctgagtccaaacgtatgacgtgaggtgttaggtgcaatccccattcgggacggacacgcgagtaaaggtctaacatgtttcaactttccagttagtcgccgtcctatattggcaagaccggatggccgtcaaccagttccattctgactatttgccacattgattaaagaagtaggagcgttagtcggcgcgtgcgcgggactatttagcgaaggtcgccgtatcgcgggtggcggcgtttccgccataacaacaagcgtttaaggtcagagtccgcgacgaatgaaacgccgtgcaagcggctttggtacggccagtttagccaaagcctgatccgttcgccttgggttatcatgtaccagtcaagcggtcatcgcgggcggcgttatcatggtaagggcgtcgaacggtcgtgaaagtcttagtaccacacgtaccaacttactgaggatattgcttgaagctgtaccgttttagggggggaaggttgaagatctcttcttctcatgactgaactcgcgagggtcgtgttgtcggttccttcaaaggttaaagaacaaaggcttactgtgcgcagaggaacgcccatttagcggctggcgttttgaatcctcggtcccctttgtctatccagattaatccaattccctcatttaggaccttaccaagtcaacattggtatatgaatgcgaccttgaagaggccgcttaaaaatgacagtggttgatgctctaaacttcatttggttaactcgtgtatcagcgcgataggctgttagaggtttaatattgtatagcaaggtacttccggtcttaatgaatggccgggaaaggtacgcacgcggtatgggagggtgaaggggcgaatagacaggctcctctctcactcgctaggaggcaattgtataagaatgcatactgcatcgatacataaaacgtctccatcgcttgcccaaattgtaaagtgtctatcacccctaggcccgtttcccgcatattaacgcctgattgtatccgcatttgatgctaccgtggttgagtcagcgtcgagcacgcggcatttattgcatgagtagagttgactaagagccgttagatgcctcgctgtactaatagttgtcgacagatcgtcaagattagaaaacggtagcagcattatcggaggttctctaactagtatggatagccgtgtcttcactgtgaggatcgtttgcccgtaaaactaactggcaaaagcctaagtgctgtttcgggtgcaatggtataacttcccacatttagccgaatagcgccaacagcgttattatttggtcccacccccgcagcttgccagctctttgagtatcatggagcctatggttgaatgagtccaataacgaacttcgacaggaaccaagcagtgggcgatgtcagcgacaattccactttggtagaggtcgttcttttgtagaaaacaatctaacataactatgacactttcggtaaattcaccacctttaccagggtcgtaagtggtcaagccacgccgaccacttcataagcattggtggtttataacttgttgcgttcctagccgctatatttgtctctttgccgactaatgagaacaaccacaccatagcgatttaacgcagcgcctcggaataccgtatcagcaggcgcctcgtaagaccattgcgaataccaggtatcgtgtaagtagcgtaggcccatacgcgagataaactgctaggaaaccgcgtctctacgaccggtgctcgatttaatttcgctgacgtgatgacattccaggcagtgcctctgctgccgggtccctctcgtgattgggtagttggacatgcccttgaaagatatagcaagagcctgcctgtctattgatgtcacggcgaaagtcggggagacagcagcggctgcagacattatatcggaataacactaaggtgagataactccgtaactgactacgcctttctctagactttacttgaccagatacagtgtctttgacacgtttatggattacagcaatcacatccaagactggctatgcacgaagcaactcttgagtgttaaaatgttgactcctgtatttgggatgcgggtagtagatgactgcagggactccgacgttaagtacattaccctctcataggcggcgttctagatcacgttaccgccatatcatccgagcatgacatcatctccgctgtgcccatcctagtagtcattattcctataacccttttgagtgtccggtggcggatatcccccacgaatgaaaatgtttttcgctgacaatcataatggggcgctcctaagcttttccacttggttgggccagctaggcctctctgcccggagtttcggcgcagtgctgccgacagccgggcattgtttttggggcgttattcgagggcactcggacctaacttgtcgggaccacccggggtagtcatcgggcttatacagcgaaaagcccagcacccggctcctcgctatggaaggtcattagctccggcaagcaattaagaacaacgcaaggatcgcggatataaacagagaaacggccgaatacacctgttcgtatcgtatcggtaaatagcctcgcggagccatgtgccatactcgtctgcggagcactctggtaatgcatatggtccacaggacattcgtcgcttccggatatgcgctctatgtgacggtcttttggcgcacaaatgctcagcaccatttaaattagaccgactccagatctgtaaggtccgccacgcagacgacagcccacggagatcactgaccgatctatctgaacggcgaccatttgtgtggtactggggcggagagataactacggtgccgcttacaacccctctgtcgtcgctgacgtttgtagtctagtctcattatgattgtacgctattcagggattgactgataccggaagacatctcaaatgaagtggtctatacgacagagaccgtgcacctaccaaatctccttagtgtaagttcagaccaattcgtactttgttcagaactcacattttaacaacagaggacacatgctctaccttcatgatctattgacgtccctgaggctgcaatacatgtaacgaggcagtatccgcggtaagtcctagtgcaatggcggttttttaccctcgtcctggagaagaggggacgccagtgcagttatcattaatgtggaaattgggaggactcttggccctccgcctttaggcagtgcttactctttcataaaggggctgttagttatggcctgcgaggaaatcgcatcgacacaataaaagtacaccaaccagcagaaaacaggtacatatacagtttaacgacctggttcttaccggagcgcctccgtacacagtacgatcgcacgccccatgagatcaatacgtataccaggtgtcctgtgagcaacaaaagcctaaggatctaagatgactacagtagcatagccatagaacatggcactgaaatatcgatgggcgtaaaagtgaacaacgcagacgatggtaggaggagtcgtcagaccagatagctttgatgtcctgatcggaaggatcgttggcccccgacccttagactctgtactcagttctataaacgagccattggatacgagatccgtagattgataagggacacagaatatccccggatgcaatagacggacagcttggtatcctaagcacagtcgcgcgtccgaatctagctctactttagaggccccggattctgatggtcgtagaccgcagaaccgattggggggatgtacaacaatatttgttagtcacctttgggtcacgatctgctaccttactggaatttagtccgtcctataatttcccttgcatataagttgcgttacttcagcctcctaactgcacccttagcacgaagacagatttgttcttacccatactccaccgttggcagggggatcgcatgtcccacgtgaaacattgctaaaccctcaggtttctgagcgacaaaagaggattacgacgccaagccactataaatgctaattgagtcgaagaaggtactcctttttggtatttgtgctactctcctcataagcagtccggtgtatcgaaagtacaagactagccttgctagcaaccgcgggctgggagcctaaggtatcactcaagaaacaggctcggtaacatacgctctagctatctgactatcccctacgtcatatagggaggaacacagatattgcagaagcgggaatgaggttgatattacatcaagtatcaacagacgacctcagaagggtggtcttttaaaatgacaacgtacattaagatgcagacaaacactactatgctggttaccgtgacagccgcacggatcccatataatgcaatcgtagtctacctgattgtacttagaaatgtggcttcgcttttgcccacgcacctgatcgctcctcgtttgcttttaagaaccggacgaaccacagagcattagaagaatctctagctgctttacaaagtactggttccttttccagcgggatgttttatctaaacgaggatgtgaaaatgtcatatgtgcggcaaaaatagacgacatttaagaacctagcattataggatggttacatggttttcgttattgctagccagcctcataagtaacaccactactgcgacccaaatgcaccctttccacgaacacagggttgtccgatcctatattaggagtgttgtattaattcactctagagtaatggatcacggtgccagaaactaaggtggtgtaggactagatgcaagtaacaacggtcgtactaaaatcagctacgcgatcgccgacttagaaggctgagatggttgcataaggagaccggtgtagccaaggacgaaagcgaccctaggttctaaccgtcgactttggcggtaaggtatcactcaggaagcagacactgatagacacggtttagcagatcgtttgacgactaggtcaaattgagtggtttaatatcggcatgtctggctttaaaattcagtatagtgcaggagaaacttgtctactggcagacctcactatcttttaggaaggtcacgaagcggctggagtgatggctagtctcagccactgtcaacgggaagcgcgacgtttatggtcaatataaactagcagtttaatccgtatggcgatcttagcggatgttacaggatggtggaagctaatagcgccggtgagagcgtaatctgccgtctccaccaacacaacgctatcgggtcatattataagattccgcaatgggattacttataagtagccttaacgatatccggaacttgcgatgtacgtgctatgctttaatacatacctggcccagtagttttccaatatgagaacatcaattgtacatcgggccgggataatcatgtcatcacggaagtaactgtaagacaaataattcaaaagagatgtcgttttgctagttcacgtaaaggtgtctcgcgccacctctaagtaagtgagccgtcgagacattatccctgattttttcactactattagtactcacggcgcaataccaccacaaggagaagatgacaaagtagaagctagacaactatatcaaatcgttgtgtggtcttaaaccgacacagtagcattcatcgttggtcgaaaaacatccgtccccgagggggatagtcactgacgcggttttgtagaagcctaggggaacaggttagtttgagtagcttaagaatgtaaattctgggattaaggatgtggaaggtcacagcctcgttggaggagatactacggtcccgcttttcgtgggtgacaaaggtcgcaaaggtttccttagggaggtcgtttcccggatctttatctacatctcctgggtgaaggggatgatctttctctacatgtcctgggtggaggggagtttccttgtatgggtggaacccaacccgccggtgagggtgagttacggtcggcggtcatatgtgggtatgacgggtatgacgtcataaatagtcgttgtcaaaatgggaggtggaagtccttactgtagtcacccgtgaaggtggagaactggcaggacatctctaggtcacctaaacgtgcgaagtgtgcgaaattaccaccgtaaattcgtcctactgaaagtgcttacgcatcttgagagagattgcagagagccaggtcaaatacattgagaaatctgtatatgtactttggtaacgctctaaggtaggtacacgttagtgatataaaaagaaggcgacgacggtagcagaggtctagaaaccgcatgaacgaccaacttatttgaagagctagtgcggtggaattgggtcggaagaacttaaattgttagagcagtttatgggtggtaggttacatctatttacttcaaaacgcggtgccctagcccacaagcattgctttgtaaaattgttgaaggtaacttgtaaaagccgaacatgaacgatggtagctaagagtaggccgggagtgtagacctttggggttgaataaatctattgtactaatcggcttcaacgagccgtacaggtggcacttcaggaggggcccgcagggaggaagtaaactgctattcgtcgccgttggtggtaactaattgtgttccttgccactacaattgtatctaagccgtgtaatgagaacaaccacaccttagcgaattgatgcgccgcttcggaataccgttttggctacccgttactaagcccatcgcgattttcaggtatcgtgcatgtagggttggaccgcacgcatgttaaactgctggcgaagtgcgattccacgaccggtgtacgatttaattacgccgacgtgacgagtttcctgttaatgcttcacccgccggaccgccctcgtgatggggtagctgcacatgagcttatgacaaataacgagagtgtacttgtttaatcatctcacggtgaaagtcgggagaacagcagccgctacacacattttaccgcaactacacttagctgagatatttccatagatgactacgcatccctctagaccttacataaccggatacagtgactttgacaggtttgtgggatacagcaatgacttgcatagctgcgtatggaggaaggaactcttgtgtgttaatatgttgacccctgtattacggatgcgggtagaagatgtgggcagagacacccaggtcaagttcttaaccttctcgtaggaggtgttccagttcaccatacgaccatatcattcgagcatgacactatgtacgctgtccccattctggtagtcatcatccctatcacggtttcgagtgagtggtgacggatattccccacgaatgaatatcttattcacagtcggtcatattggggtactccttggcttttccacttggctcggtctgttaggcctccgtagcgtgagtttcggccctgtgctgcccagtgtcggccattctcattggggcctcacttctggataccccgacctattttgacggcaccattggcggaagttgttgggcttatgcaccgtaaagtcctccgcgggcctcccccctacaaaagatgataagctccggcaagcaatattgatcaacgcaaggatcggcgatataaacagagaaacggctgattactcttgttggtgtggtatcgctaaattgcgtcgcggagccttatggcatagtcgtccgcggagcattctggtaacgcttatggtccatagcacattcatcgcatccgggcatgcgctctatttgacgatcctttggcgcagagatgctggccacgtgctaaattaaagcgactgcactactgtaaggtccgtcacggagacgacggcccggggagagcactaacccatcaacctgtacgggaacattctatatcgttctcggacggacagattactagagtgccgctttcagcccctctgtcgtcgccgacgtctgtaatatagcgttgttgtgattccactctattgaggcattaactgatgcggaaggagatctggaatgaactggtctatgtcacagaaactgtgcaaatacctaatgtcgttagtgtaggttctgaccgatacgtgcttcgttgagaactcacaattttacaactggggacataaaccctacgcccatcatctactgacgtccctgaggctccagttcatgtaatgggagagtatccgccgcaagatctagtgcaatggtggtatagtaagctcgtactgtagtagaggcgacacgggtaggatcatcagtaataaggatagtgggaaaactcacagaccaccgcctatagggggtgcttacttttacaaaaagcgactgttagtataaccccacgaggattcgaaaaggtgaaccaacccggtcgatccggagggacgggcctcaaagccgcgtcacgacggctgtcggcccgtaacagaaaccccggaataagctcccgtgagcctggatagaacagccctggtgggccccatcagtagcccgaatatgtcgcttttcgggacgtgggccgaggagcgataccttccactaatcgaggccgttcgttaatacttgttgcgttcctagcgcctatatttgtctctttgccggcttatgtggacaagcatagcatagccatttatcggagcgcctcggtacacggtatgagcagacgcctcgtgagaccattacgtataccaggtgtcctgtaagcagcgaaggcccatacgcgagatacactgccagaaaaccgcaggatagtagaccgggaagaccaacgttttttcactactccgaaagaacacactgaagggaacggtgtaggttcggtgagtccgggactaggtgtccatgtcggagacctcagtggtgacgtcctcgtagtataggtttaccgccaaaaaatgggagcaagacctcttctcccctgcggtcacgtcaatagtaattacacctttaaccctcctgagaaccgggaggcggaaatccgtcacgaatgagaaagtatttccccgacaatcaatacgggaggtccacgctctaagtcgcttgcccaattgtggctaccgcattgctcagaacttcgggtactggccaaccttcaagaagcctagtcttggtgcgtcaccccagtcacgtagcatacccgtcatcatctatggtcgtaggtccaacaatcgtggcgccattgggtaccacttcatcagagctgctcgcatgaccagctatatctggaacatcgctggtgggtcttatggtcgcttttgtgggaaccatcatagtcgcaagtctggccttcggtatggaactcgtcgtcccgactacaaccatagctagtctcggtctcggctttgttgcaatgcccttcgttactacttcaacggtcgtggtgccggtcaaaccgctcgctaaagcaagcgaagaaacagctaaacttagttgtgtcgaaacatcctaagtggtcgggttgctcgtggagcatgcagctagcccagaacctttagcttgtgtggtcttcgtctcggtagtcagaaccaggtcggtctgaatggttggactcgccacatcaactaggtcagctattgaagtgccaactaaaggtcgtattgaagcaatcggtcctatggcaagtcaagtgacagtcgtaggtatggcacttgccgcgcctccagaactcggtcaagctacctcataactcggaagtcgactgctctaaagcgaagttgtcaaacgaacagctatgccttcgagtaaagcaaggtgcgcaatagtaaccttggtaacttcggaactgcgtcaagccgctaactccatcggtatggaagtcgctaaagtcggtcaaacggaagcggctatcgtcgcaactagtcgaatagttgtcgaagaggccagagcaaccatggttgccattgtcttcgtggtctatgcaagacgtccttgcgtcatggcctaagcatcttcttcactggttgctatagcggaagtcgttaccgaactggtcgccagtcgaatcgtttgccccatggtagtcatcaccaccatcgcggaaaccaacggtccgaactcacggtaggtagtccacgtatgtagcccacctttcgaaggaatcgtggtcgccggtctcctagaaacggtatatgtcttgcgtcacgcttatggaccggtcatcctggccagtagccgacttgtggtcgctatagctttcgctagtccctgccttaacgtgcagcatggtatggctattgtcgtcccggctacaaccactatcgtggtcttgaaactggtcgtcgctacaaccatcctagcattggcaccagcggtcgttgaagccgaaggtagtctctaactggttttcgaagctagtcaaacagtagcgccatatggcctagcctgaaccttagaaaaaggagtcgaaggtcctaaacccgctggtcgcgaacgaacaaaaacggtcgttaaaggccgtccggaagcggaaggtcgtcgccccaggtgaacaagtcctaaagaaacaaaaagtctctgtagtctatttaaaacccaacgcaaacgcgaacgcagaatcgtctgaacccacgtccatcattacggattatataaggtttctgtttcgttaactaggtagttattgatgtcatccgcactacaagctaacaggaggtaacagatagagcatgagtggtagtagggatgaaacaggaagtactaattacatacagggactcctggttgggtgaccccgggacacgtacgtgtcctaataaacaggaggcgggtggtttcctatctactacggacagggattttccccgagtagcgaaggatatgaaacttctagttatagacatataagacgtagtccaggaagtcggctgagtccatgaggtcagttttggaggagaagtagttgtcacgatccttagttaagataacaaagtccgagtagttatcacgacttgctgactgcgtccactatgtttccggggtgggcatggggacttgcacacggataactccatccggattattaagacgaggtggggtgtgctgggctcccaggaacttcatcggagtgacgtagaaccttcagtttgagtccacgtaggacaccagcgctattggtgccgacgacgagtacaaacatccggaaacttagcatattaggtaagagtttctgtatgctcggacgtcgtcgttagagcagacccagaaggtgtccatggacacacatcatacaagacaacttggtcaacttttacggggctggggccaattatcccgggagtcctcacgatcagaaaccgactggtttgtcacactctggttagaggaggggtcaccacgatgggtgagggggtggtgggtgtttatacaagagtctgggactccaaagacgatattacgacgagacgacttatccacgtactttgtttcccaaacccacgcaactccacctttagtccacacaaactagtacgagacacccggattcaaggtcgtgaccgaccatgtaaaacatttgttacaagacttcttttaaacactatcttcctgcccagtagcggatgattatcgttgttgctagccggcgtggaaggtaacagcaccgctgcgagcctaatgtgccgtttccacgaacacaaggctgtccgatcgtatattaggattccgcaatggggttagcaaatggcagcctaaacgatattggggacttgcgatgtacatgctttggtacaatacatacgtgttccagttgttatcctgtatcggaacatcaattatgcatcggaccagcatattcatgtcatctaggaggggcgcgtaggataaataattcaattaagatgtcgttttgctagtatacgtctaggcgtcaccggccatctgtgtgcagatggggcgacgagacattgaccctgatttctccacttctaatagcacacaccgggcaatacgagctcaagccagtctcgcagtaacgctcatcagcaaacgaaagagtttaaggctcgctaattcgcactgtcagggtcccttgggtgttttgcactagcgtcaggtaggctagtatgtgtttttccttccaggggtatgtggctgcgtggtcaaatgtgcggcatacgtatttgctcgacgtgtttgctctcacaaacttgacctggagatcaaggagatgtttcttgtccaactggacagcgcttcaacggaatggatctacgttacagcctgcataaagaaaacggagttgctgaggacgaaagcgactttaggttctgtctgttgtctttggcggaaaacttccattcaggaagcagacactgattgacacggtttagcagaaggtttgaggattaggttaaattgagtggtttaatatcggtatgtctgggattaaagtatagtatagtgtgttaatcggagacgaatttaagacacgagttcccaaaatcaagcgggctcattacaacggttaatcctggtagtttacgtgaacaatgtcctga

SEQ ID NO: 344 - DNA, 12837 bp, Artificial Sequence
  SIRV6
ggcgaatagacaggctcgcctctgtcacgctaggaggcaattctataagaatgcatactgcatcgatacataaaacgtctcgatcgcttgcgcaacttgtgaagtgtctatcatccctaagcccatttcccgcatattaacccctgattgtatccgcatttgatgctaccgtggttgagttagcgtcgagcacgcgggacttattgcatgagtagagttgactaagagccgttagatggctcgctgaactaatagttgtcgacagatcgtcaagattagaaaacggttgtagcattatcggaggttctctaactagtatcgatagccgtgtcttcactgtgctgcggctacctatcgcctgaaaaccagttggtgttaagggatcccctgtccaggacgccacacgtagtgaaacatacacgttcgttgggttcacccgggtcggatctgagtcgaccaaggacacactcgagctccgatccctactgtcgagaaatttgtatcccgcccccgcagcttgccagctctttcagtatcatggagcccatggttgaatgagtccaataacgaacttcgacatgataaaatccccccctcgcgacttccagagaagaagactactgacttgagcgttcccagcacttcagccaaggaagttaccaattttttgtttccgaatgacacgtgtctccttgcgggtagatcgccgaccgcagaacttacgagccaggggaaacagtaaggcctaattaagtaaagggagtaagtgttcgaacgcttcagatgtaaccatatacttacgctggatcttctcccgcgaattttaaccctcaccaactacgagatttgaggtaaaccaaataagcacgtagtggcgctatccgactgttcccaaattgtaacttatcgttccgtgaaggccagagttacttcccggccctttccatgcgcgcaccataccctcctagttccccggttatctttccgaagagggagtgagggcaagacgaatctgcgtcaacgctaaaggccgtcaaaaagcaagagggcgtcgcgcctgggaaaaaggtagtcaagaaaccatcaagcttaaatgtcgggaaattgggtttgcgccgccttcaggggcagcgatgggggcgacaattgtggaccgtatggactccattatgctgggactcctcgggtgtaagggagagaccctgcggcgtacttcattttgtatatgcaacgtgcccaagtgacgccaggcaagtctcagctggttcctgtgttagctcgaggctagacataggagctgaagggtagttgttgaaaaagtaggaatatctagcctagatgtcgtttcaggcgaaggactctaaggtcttaaaatcgttgggtgctcattcactaggttgcgaagcctatactgatatatgaatccaaactagagcagggctcttaaaatttggagttgtaaatacaggtcaaccgctctaaagcgaagttgttggacaaacagttatgcgtaactgtaaagcaaggtgcccaagtagactcttactaatttgggaacgacggaaagtcgctaccttcatcggtatggctttcgctaaagtcggtcaaatggaagaaggtagtcgaagtactgttgaaagagtagactgagcgacagtcgaaaccagccccaatgaacaagacgccattgcaaaacgtctatacgctacggtcaaagacgcttccacaccacatggtatagtggacgccgttagcctcatgtgtctcactcaaagaccttgcgtcacggtcatcctctttgtcagcaacgtagaaatctccggtctgtcgataccttgcgtaaagctctcatgtagcctaccttacgaagaaatcgcacaagtcggtcgcccagcggtggcatatgtcttgcctaacgtttctagaccgatcagcctcacgagtagcctgcttgtggtgtttatagtttacgctagtccaatctgtatcgtgccgcttggtatggctattgtcggcctggatgcaagcactaacgtggtcatcagactggtctgcgctataatctacgcaatagaggcaccagcggtcgttgaagccgaagacgctatttcggtggcttggtcacaagtcaagccattgcctctctgagacgccgtatgaattaatatgtaaactttgcgcgggttcactgcgatccgttcagtctcgtccaagggcacaatcgaattcccatttgtatgttcagctaacttctacccatcccccgaagtttagtaggtcgtgaggaatattgtttcaatggtcgtggcgctggtcagactgctcgctaaagtcgtcgaagaaacagctagaccatctattctctgaacttcctaagtggtcgggttggtcgtggcgctcatagttagcccagaacgtccagtttatgtggtggtgatcttggttgccagactcagtatggtcaaaatagttgtgctcgccatttcaactagtgcagttgctaaagtgccaactaaggttcgtcttgaagcaatcggtagtatctgcagtcaagtcgtagtcgtaggtatggcacttgtcgtgcgtctaggacgcgttgaagctatcttattgcccgaaggtgagtgtggctctttgatctgacaacgtgcaacctctatcgcgaccgattgtttctgcggaccatgttgtcctcatagtttgggcatgtttccgttgtaggagtgaaaccacttagcaggagccgaaagtctgggacacgtcgtgggacgtatcgttaggactatgggactagtcgtcttcggtcttacaaatgttgcaatgccctggtacgtttggggttgaaaaaatctattgtaccaatcggcttcaacgtgctccacggctggcacctgaggaggggcccacaccgaggaagtagactgttatacgttggcgatggtggtagctaactaagttgcttgccacaacaacagtatcaaagccgtataaagggaacatccacactttagtgaatcgaagaggcctatgcctcgtatcatctatggtcgtaggtaaagcaatagcggaaacattggatgtgacttcatcaggactgctcgtatagtgagctacttatgaaacatgaatggtcggtcttgtggtcgcttttgtcgaaatcaccggttattgtatgagtagtgatttgtaagagttgttagttagctcgttcaggtaatagttgcccacacaacgtcaaaataagagaacggtcgtaacattatccgtgattttcttactactatcagtactcacgactcgactctgccgcagctacgtatcgcctgaaagccagtcagcgttaaggagtgctctgagcaggacaactcgcgtagtgagagttacatgttcgttgggttcttccgacacggacctgagttggccaacgtcccacttgaggtctgtgccccggtgatgagaagtatgcatctcgttcttgcagcttgtcagtactttcagaatcatggcgtgcatggtagaatgactcttataacggacttcgacatggcaataaccccccgtttctacttctagaggagaaaagtattgacatgagcgctcccggcacaagggccaaagaagtctccaatttcttatttccgaatgacatgcgtctccttgcgggtaaatcaccgaccgcaattcatagaagcctgggggaacagataggtctaattagcttaagagagtaaatcctgggatcattcagtagtaaccataaacttacgctggggcttcttcggcggatttttacagttaccaaccaggagatttgaagtaaatcaattgaggatttagccgcgctatccgataatctccaaattaaaacataccgttccatgaaggctagaattacttaccggccttttccatgcctgcgctatacccccccactttcccgcttatctgtccgagcggagacagtgcgatcctccgttaagatattcttacgtatgacgtagctatgtattttgcagagctagcgaacgcgttgaacacttcacagatagtagggattcgggtaaagggcgtataattggggactaacataggcgtaaactacgatggcaccaactcaatcgcagctcgagcgccctgaataacgtactcatctcaactcattctcggcaatctaccgagcgacttgattatcaacagctgtctagcagttctaatcttttgccaacatcgtaatagcctccaagagattgatgatagctatcggcacagaactgagacgacgccgatggatagcggacttttggtcaaccacaattccccacgggacaggtcctgcggtgtgcatcactttgaatgtacaagcaacccaagtgggccgagcctggactcagctggttcctgtgtgagctcgagacttgggatgacagctctttaaacatagagcgggggcgtcgaacggtcgagaaagtcatagtacctcgggtaccaacttactcaggttattgcttgaagctgtactattttagggggggagcgctgaaggtctcttcttctcatgactgaactcgcaagggtcgtgaagtcggttccttcaatggttaaaaaacaaaggcttactgtgcacagaggaacgcccatctagcggctggcgtcttgaatgctcggtcccctttgtcattccggattaatccatttccctcattcacgagcttgcgaagtctacattggtatatgaatgcgacctagaagagggcgcttaaaattggcagtggttgatgctctaaactccatttggtttattcgtgcatcaccgcgataggctgacaaaggtttaacattgaatagcaaggcacttccggtctcaatgaacggccgggaaaggtacgcgcgtggtatgggaggatcaaggggccaatagaaaggcttctctctcactcgctaggaggcaaatgtaaaacaatggttactacatcgatacataaaacatgtccatcggttgcccaaagtgttaagtgtctatcacccctagggccgtttcccgcatataaacgccaggttgtatccgcatttgatgctaccatggatgagtctgcgtcgagcgcgccgcatttattgcatgagtagggttgactaagaaccgttagatgcgtcgctgtactaatagttgtcaacagaccgtcgagattagaaaatggtaccagcattttcggaggttctctaactagtatggattacggtgttttcactgtgctgcggctacccatcgcctgaaatccagctggtgtcaagccattccctctccgggacgccgcatgtagtaaaacatatacgttgcacgggttcactgcggtccgttctgagtcgaccaaggacacaatcgagctccgatctgtatcctcgacaaacttgtacccaacccccggagcttgccagctcctcgggtatcatggagcctgtggttcatcgcgtccgatatcaaacttcgtcatgataaagtccccccctcgggagtaccagagaagatgactactgagttgtgcgatccctgcacttcagctaaggaagctaccaatatttagtttctgagtctcacgtctgacctcgcgggtagattgccatgcgtagagcttacgagccagcggaaagtgtgaggcgcttttaagtatggcgagtaagtgatccaacgcttcggatatgactatatacttaggtttgatctcgtcccgagaattttaagcctcaacatctatgagttatgaggttagccaaaaaagcacgtggtggcgcccaccgactgttcccaaactgtagctctttgttctgtcaaggcccgactttcatcgcggcccattccatgtgcggaccataccgtcctaattctttggttatgtttccgatgtaggagtgaacctacttgcctttgcgtcttaataccaatgaaaaacctatgcactttgtacagggtaccatcgggtttctgaactctcagatagtggggatcccgggtaaagacctatatctgcggtccaacttaggcataaacctccatgctacctagtcagacccaccctgcacgaggtaaatatggcacgcgtccgacctggttcctggcgttctacgctgccacgtgttcattaactgttgtttggtagcacaaaagtattaccatggtcctagaaattcggcacagttagttcgagcctaatgtcacaaatgacgcagaacgccaatgagtgttagacattaggtggagttcagttcggtaacggagagactctgcggcatacttaattatacatttgaaacgcgcccaagtgacgctaggcaagtcagagcaggttcccgtgttagcttaagggtaaacatacaagtcgattgaagatgggtagggggcttcaaatcgtccagcactctacagtacctccgagagcaagtagggcaccctgtagttcgaagcggaactatttcgaggggcgagcccacatcgtctcttctgcggatgacttaacacgttagggaggtggagttgattccatcgatggttataaatcaaaaaatcggaacgctgtctggaggatgaatctaacggtgcgtatctcgatcactcagtcgcttttcgtactgcgcgaaagttcgcaccgctcatacacttggttccgaagcctgtcctgatatatgaatccaaactagagcggggctcttgacgtttggagttgtaaatatctaatattccaatcggcttttacgtgcaccaccgcaggcggctgacgagggactcacaccgagaaactagacagttgcacgttggaagtagcgccggctaagaaagacgcctggtacagcaggactatgaaacccgtacaaaggcaacatcctcacttcggtgaatcgaaacgcggcatcaaggttactttttggatacctgaaacaaaacccatcgtagtccttagacttgggacactttcacctctagggcccatatctggaaatagacgccaagttcaatccgtactccgacgtacgatggaacagtgtggatgtgacgagcttcatttatacccttcgcgcgccggaccggggtccgcaaggcgcggcggtgcacaggaaacattaaatcaaagaagtttatcaaccaattagtacagtggcatgttaagtaaaacagaaagaacgccaagtggcaacaaatgacgtaattatttaagcaaaaagcgtaaacgcttacaaaggctatttaaatatcagtaaatcgttggaaattgggtatgtgctgccttcatacgcaaaaatggatgcgacagaaacgagttgtatggcctccactacgctcgcctgccgcggaccctaaacgacagtcgtttgcccaactacggctacggcatcgctcagaacttcgggtcttggcccacctttctgacgcctagtcaacgtgcgtcgcctcagtcttggtctgtatgacggtatctgctgatcggtagggagaccgagaatctatcgggctatgtcactaaaactttccaaacaccccatgtcgatactgaacgaatcgatgcacactcccttccttgaaaacgcataaacatacaagtgggcagatgatgcgtacgcccttctaatacatccaacactctacgccctcttcaagagctggaagggcaccctgcacttggataagagattatctcgtaaggcaagctcgtaccgtcattcatgcggaagagttaacacgattggaagtagggatagtttcgaacctcggttactagtcctaataagggaacgctgtctgaaggatgagtgtcaaggacaaaaagaagaaatatcaattgcaaaaataactataggtacttctttgaagaaaccaaacgtgagtttctaacacgactaaatccatttgatctttgagaaagtcgaagacgaatggtggcatgtgccatgctagcctgcggagcactctagttatgcatatggtccacaggacactcgtcgctttcggatttgccctctatgtgacggtttttaggcacacttatgctcagcaccgtttaaaccagaccgacactagatctataaggtccgccatgcagacgagagcacacggagatcaccgagcaatctatctgatcggcgaccatttgtgtggtactggagccgagaggtaactacgatgccgctaacaacctctcggtcgtcgctgacgtttatagtctagtctcattataatcgtacgctattcagggattgactaataccggaaaacatctcagttgaagtaatgtatacgacagagaccgtgcacctaccaaacctctttagtctaagttcagactaattggtagtttgtctagaactcagattttatcactagaggacgcacgctctatttttatgatccattgatgtccctgaggctgcaatatatgcaaccaggcagtcttcgcggtaagtcctagtgcaatggggctttttttccttagtcctcgagaagaggagacgtcagtccagatatctttaatgtggtaattggaaggactcttggccctccacccttaggcagtgtatactcttccataaacgggctattagttatgaggtccgaagattgaaaaaggtgagcgaactcggccgaaccggaaagacggacttcaaagcaacctgaccacggttgcgcgtccgtatcaagatcctcttaataagcccccgttactgttggttgtagagcccagaacgggttggccagatgtgcgactatatcgcttagtggctcttgggccacggtgcgttaccttgcaggaattgagaccgtccgttaatttcccttgcatatatattgcgtttttttgtccttttatccgctcacttagaaaagagacagatagcttcttaccggtgcgcctccgtacgcagtacgatcgcacgccccatgagaacgataggtaaacctagtgtcctgtgagcgacaaaagcttaaatgggaaatacgcggccataagttggaggtgggtttatatcgcgtatccatccaacttaactgaaacgcgaagcagtagacagtgttgatcgagatttgcgaagggaaacagtaaaagtccagggtgtcgttaattacgacaaaactaaagactgtatagttagaaggatcaattgggctgatttagaaatggtataagttaaagaaatggaaacttattcgacaaaaagaaaaactcatgatgtatagatggaaactgccataatgtcgattcgagttatatttttagattttggtaaaatatccaacatgtattaacgaaattttgaagtatagatcaaactattcttcaggtacagcatcaagcattcggtagcataagccaaacaagtctttgaagggttggacatagcgagttgtgtagaaagttacgaagacttcaacagaaaaagagtttaaaaggaccacgtatgccaaatcgacaacaatatagtcgttctattctgcgatatgtaagatagagacacatcggcaggtagcatagaacttgggtcaattattatttaagtgcggtaacaaacaaacttagggaatattattgtgctacagcaaatgccttgaaaagtcgagaaagactactatactcgtcaagttcgtaaagacttaacagtaattgtaatgcaaatacttagcgagattgattccttcccagtagtcatctttcctttagatattagaacagcaattttagattttgtacatagtggagaaaaggacgtcattttaatggatgaaccagacgttaacgtcatttacttggtcgttgatttcgaagactcagtcatcaaaattgtagcttcgctagctaatgtgcttaaaatcatcatagtcaaagtgtacgtggtcgtggtaataaacaaccttcattactgtacaaaagtgccagtttgttacattatcgaacgctgtatagaggtatcatttcacctatttgacaactaggtgataaaccttcggtcgctagacgttgttgttattgaaaaaatggaagataatctatacttaatccaaaacaacccagaccaagctcgtatataaatggaagtcgtcaaaattggtttcgttcaaataagttgggactgatgaatcagttttctgaacttcaccgctattagcgtcctagttgtctacataattagtatcattattgtagtagtttaaatcgctaacaaccaaaaaatccttgacatgggtaacgacgttattggggaaccaatgctcagtgttggtgaaagaatcgttaggtcgaactattggtacgttctaataaaagacgacatagaaattcgttacataatcaacgtcactactaagggcgtattgcaaattagttcataaattattaacagtttgcacctaatagttctagtccttaaaaaggtagaagacgtaggtaatgtcagttgcctcaatgtagtcaggtaaaaagtatatgtgctgatggcaaacttcatctttgtgagagttgagcatgtataacaacatcactcagtataaccgcttggttacacaattagtatcatgcctatagaacgccttatcattcaggtcgtcgtgatagtgaaggggatcaaagtcaaaatctactttgtcataactctttacggtatcccaatgcttggtataagtgcttaagaaattgtttaaacagaaactcaagtataagcgaaaacaagttacctggaaaaagaagaagtgcgtataattgatgaacgagtcgaagtcgaagttgttcaacaagagagttaggtagtgccgcttgaaaaagtaatagtgcaaataagaaagtaagactgtatcggagacgactttttaatagtagtaattctcggtacaactaaaccagtaatttcagacactgaaatagaggacttcgttaggtacgaagcaagttaactaaatgacaattaaattgagggtaaatatcacaaagaaatcatggaagatttcgaccgaatacaggaaaatttagattaaaggtttgtcgtcgttgaaataagaagaagcgaaacggcattcgtttaacaaaacgtcacatatttaggtatagtagattgcgttcacaaagaaatttaaagtcttgtaattatggtggtcgatttattggtagtatatttggaaatagcatgcaattttggaatggacgaagaacctgacatctgagctattgtaagtttaatttaccatttcgtcattgtatatgcggtaaacgtaaatttacacatatgacacgaactttgagttttattagcctgcctaattgttggtaacaatgtaatggaaattggcgatgactatggggaaagagcaatcaactcaccataaatttgtgaacgcagttaagtaattggcatcgcgcgcctaatcgtttacattcgcatggaacaagaagaaagagacctattcgtgggagtcaatggctatgtggaaaaacatgaactgccaaattcggctaaccaaccagaaatggtcatggaaaattcttgcgtcaaagttcgcggtgacgtttacgaagaagctaaacttgtgcttgtttagaaagttaggtgcgtcctggttttagtaaatttagaaaaccattttgttgtttgcgacagttaaataaaacttaacgacaaagaagtgacttgcgtcgtagattaactggaaattaaagtggtatctaaaatggggtttgccgatgcggtcttcaaagtctaaaattcttgaagtttgcgtttggtcgcaaaaattatggatttagtcgattattgcctactaagcagcagtttagaagtttttaagatagttacgctagaagaccgggagtatacttagttcaatcttcaataccttatattattgtacacctaccggtcaccagccaacaatgtgcggacggcgttgcaactttcagggcctaatctgaccgttctagatacggcactgtgggcaatacgaggtaatggcagacacccagtgtcgaacaacacctgacctaacggtaagagagtcacataatgcctctggccgcgtgcccagggtatatttggtcagtatcaaatggactgagatgaatctttacaccgaagcggaaacgggtgcgtggactagccaggagcaaacgaaaaatcctggcctgcttgatgtctcgtaatgttcttagagatggacgaaatgtttcacgacctaggaaaaggtcgccctacaaaatagatttgtgttactctcttcataaggagtccggtgtaccgaaagaacaaggcgagcctaggtagcaaccgccggctacgggggtaaggtatcactcaagaagcagactcagtaacacacggtctagctgactgtctatcgcctaggtcatatagggacctttgatatctgcatgtccagctttagaattcactttagcgcgcagatttgggtcgagataaaatcaccagtacccaagaccaggggggctcggcgcgttggctaatcctggtacatcttgttatgaatattcagtagaaaatttgtgttagaaggacgagtcaccatgtaccaaaagcgatattaatcggtgggagtattcattgtggtgaagacgctgggtttacgtgggaaaggtgcttgtgtcccaacaggctaggatataatgctgaaaccgttccccaagcgttcagggtgggatttgctacaacttccgagtccaatgtgtccgtgttcatgatatatatgctcaagggcgagaattggacctagctttcgtgttagtacgtagcatggtgacacaagcacagtagatcctgcccgcgtatcctatatattaagttaattcttatgga

SEQ ID NO: 345 - DNA, 148957 bp, Artificial Sequence
  SIRV7
agttatctcatcttaatattattgtgatataatatttgcaatcgctgctgtctctccaactttcgccgtaagatcattagacaggcaagctcttgttatattttacaagggcatgtctaactatccaatcataagagggattcgacagcagaggtactgcctgaaatatcatcatgttagcgaaattaaattatgtaccagtcgtaaaaacacggttttttagcagtttattttgcgtataggcttacgttacttacacgatacctggtattcgtaatgatcttatcaagcgtctgttgaaacagtattccgaggcgctgcgttaaattgctatgatatagttatttttattagtcgataaaaagacaattatagcgattaagaatgcaactaattataacgaacggcctcaaatagtagaaaatatccctcctccgggcatctcctaaaatgccatatattcggattattgaagatggttaccacggcagttttatctagtctcataggtctttatttcgaggttattcttaccgactgtgatgcgtcgtgtcccagctttgaatgcgatatcaccggattgtctgacttggttcaccttttagattcctcattgggttatactaactgacacttattctttaagtaaggactccttattggcagtggtgaatgagatttggcattatccttattattgataattttactcctgtcgcatgaattacagtacgagcttattttaccaggataccacttgatcttatggaggatactctttcaattcttgaattggacccacagagatgagtgtactagatgaacgtacacattatgtgctcagttgtataattgtgtgttttcaagaaagaaggtatacgtcaatacattcagtatcgacataaggtatttggatagtttcagtgatatagaccaatagatttcagatctctttacgtatcagtaaatacctttatagagttgattcatattaacactaattacgcttggaagaataggttttatacgctctatttcatctattttggctataacagttgtcggaattaaatagttctctcccggaactatagttacaattatcttaaccttaatttccgccactgttattgtctatacaagtttatgtcttactaagataacttgatccaccataacacgttgcatgaacctctccctttgcaagttgtctgctataaaaatgcgctgactttctgccagtggattctaaatctttattgtggcgaccgccaagtgaaatatacagtgtaaaaccataaagctgaatataactaccacttccacttctgccaccaagtagaccatgctaagttaccaccctattttgaatgtcactatcaccgtacttaccatattgttagttaaggataccaccccagcaacgtgattgcagtctattattagcccaacaagacctcagaatgcgaagtagcttatagttttcgtttgtccgtggccacataaatataggtttgtgtctgtttcacggacctaatttggctaaacgtaagtgcgacagattacgtctattacgaataagctcactgccaatataatacaaaccaagactactcttgatactaatgccacgcccatagtccaaaagatttctttctttatttccagaacaagtttaacaattacctgctatacgttgtccacctctatgttgttagcttcgtcccataccgtttaaattatacgactttgctgcactaccattatccatataagtatatgtctcatgtctggatgacagacatccaagtctactacgtcctctatcctatcgaagattgagttaaatatctgcatgaataagccggcgtcgattaaacgtataatgaagacgaccgtgttaacccgcaagctgtagtcgcgcatttatgttcaatagatagcttttagttatattgctatctctacttgttgaccttgtaagttttcgataagaattgaatggataatcttgcaccaaactatttcgactcagactttaaaatcgatctctcgactctcttctatcttttaatagccttctgtggatatttgaactatctatgcttccaaactaacgacttctccacctcttaaatcctaattttctcaaacagtgcatactactgtttcctctttaacttccatatcgcatactagcagatacctaagtagaatagggacaatagtttcttgttgttgattcttagttctttaacctcctcagtttcttacgttaccgtcttcccaaacgtcgattatctgttacctatcccggtcttcttcgacttctcgataatctaaaactatatcgttatgtttacttacttcttcccggtgatttaggtcctcatttgggtaaatcccatggaccttattgtcttcgtcttttcgttcttatatcattgtataatgttgggttcaatgttctagatttccccttttaagttctccattttgaccttcttcctttacgtccattcaaatcttctcgttctaaaaattctatgagactactttgtcataacagggattaagtgaacaagtatcctataacaggtgtaaatacgtctgctgtacttaatcctagaaattctgtactgtatctatatcttcgtgaagttcttctcgcaatacttgtgtcaccaattaacagttaacgaatacatgacgatgcggaacacctcgggccaggccgcgcacttcctatatttactttgagcagtgtaggtgtaataatatagcatgtagcctcatgcttaacttgaaccggagataaaaatctatgcacgcgaccttcacatttacaaggtttagatttttaatgctacccaaaacaaagtccataggtttttcattaagactacggcgcaaagttaagtgatttcactcctacaacagaaatatgcccaaactatgaaaacaacatggttcgtagaaataatcaatcgtaccattgcaatgtctaccttgttgttagtctatactactattgcctcaccgagttcgaaacttacaccccggtgcaccataatctaatttacgactattttaactataattgccattatccttctgatattataatgaaaacacaatggtttattgtcaattacttatgcactgttacatcttgtggtcctcggtccagcctgcgtaggatataaatgaagcacgtctcatccagattgatctatcgtacctccaaatacgaattcaacttggcgtctatatccagaaatgagccctagaagtgatagacttccaaatctttaaactaccatgggatatgtttcacgtatccaaaaagtaattataattctgcgtttccattcacttaagtgaggatgtagcctttatattggtttcatagttttgttataccaagcatgtattttacctagcactattttcaacctaaaactgttttgtttctcgatgtcaaacccttgtcagctacctgcggtggtgcacgaaaaaaccgattagaatattaaatatttacaactccaaattttaagagccctgctctagtttaaattcatatatcagtataggcttcgcaatttagtgaataagcggtatgaattttcgcggagtatgaaaagtgactaagtaatcgagatacataccgttagatagatgcttcagactgcattctgaatttttgatttataaccatcgaaggaatcaatttcatgttcctaacgtgttaagtcatcagtaaaaaagaccataagggctccccttttgaaataatactgtttcaccaccattcctttagtttaattcttgatgatttcttctcaaattacgttggttagcatgtgaaagtttatataatttgctctaacatcctgggttaatatgcagaaaatgggcttagggatgatagacactttacaaattgcacaagcaatcgaaatgttttatgtatcgatatagtatgcatttttatagaattgccttctagcatgacagaaacaagcctatctattcgtttctttatcctcctataccacgtgtgtacctttcccggccattcattaagaccaccacaaatatgtctgttgttccagtttctttcgtgtctacgtgtctccttttgtaactgagcgataccaagagtttaatatgttcctttgatgtccttattctatgtataaagagtaataatcttaagtctggagtttactcagcaaccagttgagtctaggcacagctttcttgggttgcttatatattgaaaataatgtactcaacaggatcagtctcataaggaattgtgattgaccaaaagtccgctatgcattgacgtcgtctcagtttagtacctataactatcatcattcttttggtggctattacaatgttggtaaaagaataaaactacaacacatctgttaataatcaactcgctcgattgattgtcaagaatgtttagtgatgagtatgttatttaaggcactcgagttgtgattgagttggatccattgtagtttacggctatataagtcctcaataatacgctctatacgcaaattcctattatctgtgaaatgtttaacgcgtacgctaactctataaaatacttaactatattatacgttagaatatcttaacggacaatcgcattgtatttatttgtatagattaatgaaaaagtaggtgcgaatattgtaggaccagcgatatgttctacgagttcgatttgaacttctccgttttgttttgcgtcttgatttccgatctttgcgacttttctttcgtcctgacctgctttgagctttcctttatactaactggtattctggcgaaacaaagctgtagcagaatcatgtcatgagtattaatagtagtaagaaaatcacggataatgttacaaccgttttcttatttagaggtagtgtgaagaacttttacatgaaccagcaaactaacatctctttcaaattactactcatacaataagttccgtgacgacatgactatcaccaagtatgtaactacgagttctactagaatttctcttccttagcgttcgcatacgactaccattttaaagccttcttctcgtcctggggaacctctgcctacaaaaagcgtttattgttaattgtttaaagatacagtgaaaacgacagtcgttaaaacaaaaatgatatgtacaatactacatctaagcagcgcaataacgcaacagcttgaagtatttttcacagaaaaatcgtacgtccagttctaacactttcatatgtgttcgtcgtttatgcttttagtatgaaaactagtgtgccggtgtctggagatcatccttcttgcatatgactccaaggacagccatcatggtttgtaagttcattgagactgttacgcttaactggacgaaactcgagaagatatatgattgatcgtaagaccgctttgattcgacaccatcataacacagtactcatgattatcatcatttttttagtccctattacaaagctgccaagtgaataaatctctatcacactctatgaaaatgcacttgatcgttttattgtagaaaaaatttaataaacagaatgttaatgaaggcactactgtactaatagagttgggctatatgttaactacaagactataacttattaataactcggtctatacataatttggtatcatgtatgtagtgttcaagggctatagcaattctgataaaaatttattaaggtaacaccttagaataatatactggtctatcgcaatacaaccacttctaccgtataatccgagagtggccacgataatcgaaggtatggtcaaccgttgtaagtaattctaggcgataaggaatcctttttttataaattttctttaggacattgttcacgtaaattatcaagattaattgttgtaatgagctcgtttgattttgaaaatttgtgtcttaaattcgtctccgattaatacactatactatactttaatcccagatatatcaatattaaactatttaatttaatctaatcctcaaaccttctattaaatcgtgtcaatcaatatctgcttcctaaatggaagtttttcgccaaaaacaataaacagaatttaaagtcgcttttgtcctcagcaattttgttttttttatacaggttataacgtagattcattccgttaaagcgttgtccaattggataaaaaacatctttttaatctccaggtcaagtttgtgaaagtaaacacgtcgagcaaatacgtataccgcacatttgaccacgcagccacatacctctggaaggaaaaacacatactaacctacctgacgctagtgcaaaacattcaagaaactctgacaatgcgaattaacgagccttaaactcttttatttgctgataagcattattgcgaaactagcttgagcttgtattgtctggtgtgtactattagaagtgaaaaaatcagggttaatgtctcgtcgcctcatttatatacagatagtcagtgatacctaaacgtatactagcaaaatgacatcttaattaaattatttatcttacatattcttcctagatgacatgaatatgttggtccgatgtataattgatgttctgatataggataataactgaaacacatatgtattataccaaagtatgtacatcacaagttcccaatatcgtttagactactatttactaatcccattgtggaatcttaatatatgatcggatagccttgtgttcgtgaaaacggcatattaggctcacagcggtgctattaccttccataccagctagcaacaacgataatcatccgctattggataggaaaatagtatttaaaagaaatcttgtaacaaatgttttatatagtcctaattaactacattactcgagcgaactaaaacttatgatcacaaaaataaagctgagcctaattatgtgatatgatttaaaatttcggtctatatagttataatttgatgaaataaattggattagcagtttgctagatgatttggcacagatagtcatagacgaaggacttactatgaaatagcggttttagttgtcaatgttggatttcagcgaaagcaggaatcgatgtagctaaagaaatatgtccatcattgcatttagataaggcatcttgccaaaaagagaaccaatattttgtaaagaaactagaggtcctctttatactctatgatttgtgcagctcttaaatgcaaacgacgagtaaacaggtgcgtgggtgtatggagaccttcatttttatgtatgattggatggactacgatcacattttatgggttctctgcgactgtcacgctaaattactcggaaattgacaatgtaatcgactacttgtaataacccactgatcgaactggagcataacgggtcacacatcataattttcactattttagtccgaattattcagcatcgcagtaaatgtataacaatcggccactgtccatttacatatcatcgtattccattagaattaatttaatatatagaatgtgtaagtaggatctactgtacttatatgaccatgctacatattaacatgaaaactatatccaattcttgaccttgtgtatatataatatgaatacgaacatgttggattcaaaagttatagcaaatcccatcttaaatgtttagggaaaggctttagtattatattctagcctattggaacacaagcacctttcccatgtaaacccagtgtcttcaccataatgaatactttcatcgatcgttattgcttttagtacatgatgactcgtccttttaacataaattttctactgaatattcattacaaaatgtaccaggattaaccaatgtaatgagcccccttgattttgggtactggtgattttatttcgactcagatttacacactaaagtaaattttaaagctagacatacaaatattaaagctctctatttaacctaaacgataaacaatcagctaaaccgtgtcttactgagtctgcttcttgaatgatactttaccgccaaagtcaacagttactacctaaagtcgctttgatcttttgctacaccgaattctttatgaagagagtaacgtaaatctattttgtagaacgatttttttctaggtcatgaaacatttcgttcatctctaagaaaattatgagacattaaacaggtcaagaattttcgtttgctcctcattagtccacgcacccattttcgtttcgatgtaaaaattcatattagtctatctgatgctaatctaatataccctagacacgctgacagagccattatgtgagccttttactgttaggttaggtgttgttcgatactgggtgactagcattacctcgtattgcccagagtgtggtatttaaaatggtcaaattaggctctaaaagttgtaacgccatctgcacattgttggctggtgaccggtagatgtataataatataaggtattcaaaattgaattaaatatgctttgcgctcatcctacatgagataaatatagtggaacgatgcataattctacattcgattcaggttatgaacaggaactcgtatttaaagtttttatcgttcaaaaacctaagtcttcaataacgttttgggtgggatttgcaaaccccttaccaaaatcgtaatataggattggataaacttgtcttcgtggtaagggtacaattgggacgctgaagtagtgtaacttatgagaaaggctaattataacaaaaattaaattctagtgaggtggaagattgtattttaaagatgactaataaatattgttatacatgctcctaatcggttctacggctcgcgggcaccaaaacccatgacctctaaaataaagctgagtttagacgcgtgatttcatttaaaatttcaatctgtttgtctattatatccagagatatactgcatctcctattagtttatcgatttcgcatacaatgactcagacaaagaactcactatggaatccgagaatcaggtgccaatgatcgttccgatcaaaacatgaaagctatgtggcctgacgaatacttctctcattgtttttagataaaagatcttgctgaaataggatccagtactttgtaaagcaagttgagaatcttataatgttttgaagatcatcgggttctaaaaaccaaacgtggactaattaggtgcgtgggtaaaaatctagctacatttctaagtagtttcagataaattatgataagtttatatgggatgcgtacgccagtctgcataatactttgagagaatgacaatccaatctagatcaagctatgaattacaaacggttatgaagtaaaacgggtgttacagcttaaatttagccagaataatttaggagtttcaacattgccgtagaggtgtaacaactcaccagtggccatccacatattaatatattccataacttttaactaattttatttgtaacgcgggcaaaatatattttgtttaagtctgcttgctacgatcttagacataagcttggttcaatactcgcgcttaaagaaaaatttcaaaaacagcaagtttttggactctcaaattgttacaaaatgcaccctgtacgttaggggaatggttactactttatatccattcttgtttagacagaagcacgattcccatgttaatcctccaacttcattacattgaatatacgttccctttaattttctatttgatttaaggtcattccatcatctaacactaaatttctactgattatttataacaatatgtaggaggattaggcaagatgcgaaatgctggttgtttttggttctggacattttatctcgaattaaatctgcgcattaatatgaattctatagattgacaagcagaaaacataggtctctttaagacaatgggaataattaaatacctagagcataaattactgagtaaatatcttgactcatatcatagattcctagcccccggttgctaggaaggttagtcttgtagtttccatagaccagactgctaaagaagagagttactgatatcttttttttagggcgacgtaatcctagatgatgattcatatggaccaacacttagaatattacaaatcttctagttacctaatatttttgatttgcacctgggaaatcattgcattcgattttagatcggtgtaaagattgatcaaactccatttaattttatccaaatttaccatatgcatgggataacacgtattatgaaattcacttttcgttaggttacaactagttcgagacttattgtttgctaatactacattatcctcacattagcgaatgtaattggctctctaaaaatcctcatagttgtaatgggaagccgagattattgagtgatcaccagtagctgtactattttataagctattaaaaattgattaaaataaacataccgcctgtaatatataaatcatagtcagacgaacattgctacaatctgtattcgtaccaagttatgagcgcgtatttcttatttaagtttttgtcgctcacaaaacactgggtttaccaatcattcacatgggacatgcgatcgtactgcctatgatgatatattggtaagaagttatctgtctttcttctaagagagcaattaaaaggttaaagaaatgcaatatatatgcaagggaaattaatggataatcttaattcctgtaaggtagcacattgtgacttaaaaatgactaaataatattgttgtacatctagctaatccgttctgggctttacgaccaacagtaacgaagacctattaaaaagaccttgatatggacgcgcaactatagttaagttacctagatgtccgtcttttctattcagccaaattctcttacctttttcaatctttggatctcataattaatagctcgtttatagaagagtatatactatctaagggtggagggccaaggatccttccaatcacaacatcaaagatatctggactgacgttttctcctctcaaggactatagaaaaaaaatcccattgcattaggatctaccacaaagattacctggttgtaaattttgcaatgttaagaacatcaatggatcataaaaataaaacgtgcatcctttagtaacaaaatctaagatctagacaaatttccaactagtctgaacttagattaaagaggtttaataggtacacgaactctgtcgtatatattactttaagtgaaatgttttccagtgttgatcaatctctgaataacaaacgattataatgaaattagagtgtaaacgttaacaacgaccgagagatttttagcagcatcatagttacctctcggctctagtatctcacaaatggtcatcgatttgataaattgctcgataatttctatgtactttcatttgtatggcggactttataaatttagtatcagtctggtttaaacgatgttgagcataagtgtgcttgaaaactgccacataaagggtaaattcgaaaacaacgagtgttttgtgaaccatatgcataattagagtaccctgtacgctagcatgacacatgcctccacaaagctattcttcaatacagtataaatagattcattcgtctatttttctatttatatgcgttatatttacgttgtctttaattacctgctagaattaaagacattccattgtgtaggactgagttttcagtaattcattatattaacttgaagaccaattaggcaagacccgacaagttggttgtgaatgcctccgaataattcttctaaaactatgcctgggtgttgacagcaatccattgaaacttcaggcagaaaagcttagccggtttaagtgaatggaaaaacttagaagcgttctgtattgattatcgaggaaatattttctcatttgtgacagatttccacctcccggttcttaggaaggttaaaggtgtaattactattgacgtgactgcagaggagaagagatcttgttttcattttttaacggtaacgtgatcctgaatggcgtttataatggagcaatatatttaacgtcggaattcttgtagttatctagtatttttattttgtatataggagataataattttacattcaagatttgtttcatgcttaatcagtcttgaatgtaatttctctaaatcatccatgtgccagagacagcatatttaatgaaataaactttacaaaaggtcataattagttagggagttatcgtatgttaatattactctgatctgatatttgcaatcgctgctgtctctccaatattcgccgtaatatcaatagagaggcgagatcatactgtgttttccaacggcaagtctatctaaccagttattagaggaacttgatagcagacatacaccatttctatttcaatgctatttgcttatagctttgcctaaccttcttgtttttgttatatgactactggtcaattcactaaacaggttattaggactctaatttcgttcataacttgttcgtttagttcttcgcgttcttcgaaatcctatcaatttcatgttcctaacgtgttaagtcatccgcaaaaaagacgataagagcttgcctttcgaaataattctgtttcaaactataggctgccctacttggtcttcaagatactatagagtcttcgatgatttaaagcccccaacccatgttcaatcaacttgtatgtttatccttaaactaacataggaaccagctaagatttgtttagtatcatttgggcacgtttcatatatataataaagtatgccgcaaagtttctccgttaccgaactgtactcgacctaaagtctaatactcattggtgttctatcacatttgtgacattaggtataaattaactctggagaatttctacgactataataaaagttttgtgctaccaaataactgttaataaacatgtcactatgtagaacgccaagaaccagctgggatgaatgctttatttacttcgtgcaaagtaggtctaagtagatagcatcgaggtttatgcttaagttgaaccgcaaatataggtcttttgtcgggatctccactatctgtaaattgtgaaacctgttggtaccctatacaaagtgcatagctatatcattaataataagacgtaaacgaaagtttattcactcctacttcggaaagataaccaaagaattaggagaatatggtgcgcacatagaaaggatcgggaaataactttgaccttcacagaacaataagttacaatttgggaacagtcggagaacgccactacgtgcttttttggcttaccttatattttataattgatgaggattaaaattcacgggagaagatctaacttaagtatatagttatatctgaagcgtttgatcacttactccctttacttaaataggccttattgttttccctgactcataagttctatgtttggcaatctatctacaaggtcagacgtatcacttaaaaactaaaaattggtaacttccttagttaaagtgctaggaatgctcaattcagtagtctttttctctggaaatcgcgaggggggaactttatcatgtcaaagtttgttattggactcattcaaccataggctctatgatatttaaaaagctagtaaactacgggggtaggatacaaatttcttgataatagaaatcggaattcgaatgtgtccttggtcgactcagatctaatccaagtgaacccgacgaatgtatatattttattacatatggcgtcttaaacagggaatcgcttaacatcaactggttttcagataatgagtaaccgcaacatagtgaaaacacagttatccatactagttagagaacctttaataatgctgctaccattttctaatcttgatgatttgttgacaattattagtacagcgaggcatctaacggttcttagtcaactctacttatgcaataaatgttgcatgtttgatgctgactcaaccatggtagcatcaaatacggatacaattaggcgttaatatgcagaaaacgggcctaggggtgatagacactttacaatttggacaagcaatggaaatgttttatgtatcgatatagtatgcatttttatacaattgctttctagcaagtgagaaagaagcctatctattcgtttctttatcctcctataccacgtgtgtatctttcccggccattcattaagaccggaagtatcttgttatacaatattaaacctttaacagcctatcgcgctgatacacgaattaaccaaatgaaatttaaaatattaactactgttatttttaagtggcctcttcaagattgcattcatatatcaatattgacttggtaaggttctaaatgagggaattgaattaatctggataaacaaaagggactgaggattcaaaataccaaccgttaaatagatgttcctctgtgcatagtaaatttttgttttttaacctttgaaggaatcgacaacacgacccttgcgagtttagtcatgagaagaagagatcttcaaccttccccccttaaaatagtacagcttcaaacaatatcctcagtaagttggtatgtgtggtactaagattttcacgaccatttgatgcccttattctatgtataaagagttattatcttaagtctgaagtttactcagcaaccagttgagtctaggcttagctttcttgggttgcttatatattgaaaataatgtacacaacagaatcagtctcataaggaattgtaattgaccaaaagtctgctatacattgacgttgtctcagtttagtatctataactatcatcaatctcttggtaactattacaatgttggtaaaagattaaaactacaatacatctgttaataatcaactcgctcgatagattgtcaagaatgtatagagatgagtatgttatttaaggcgttcgagctgtgattgagttggatccattgtagtttatgcctatataagtccccaataatacgttttttacccgaatccctattatctgtgaaatgtttaacgcgtacgctagctctataaaatacttagctatattatacgtaagaatatcttaacggacaatcgcattgtatttgtttgcatagataaatgaaaaaataggtgcgaataatgcaggcatggtaaaggccggtaagtaattctagccttcatggaacgttatgttttaatttgaaaattatgggatagcgcgtctaaatcgttaattaaattagttgaaatcacctagttagtatctgtaaaaattcaccaaaaaagttccatcgtaaatttataattactactgaatgattccaaaatttactctcttaagttaattagaccaatctgtttccctaggcttctataaaataccgttggtaattttcccgcatggagacagatgttattcggaaataaaaatttagaaacttctttagcacttctgctgacaacagttatgtttatactattcttctcttgatgtagaaacgaggcgttattatcatgtcgaagtttattataagtgtcattttaccatacagaccatgattctgaaagtactgacaagctgcaaatatgaaattcatatttctcatcactagggtacagacctctaataagatgtaggttaactgagattcgtgtcggaagaacccaacgaacatataactttcactatatgagttgacctgctctgagctttccttaatactaactggtattctggcgaaacatagctgcagcagaatcaagtcatgagtattaatagtagtaagaaaatcacggataatgttacaaccattttcttattttgaggtagtgtgaagaacttttacttgaaccagcaaactaacaactctttcaaatcactactcatacaataaattccgtgagcacatgactatctcaacctggataacaattaatgctcatatattgagaagttattaagcgagatatgcgtttaaggataatagacactttacaaattgcggataccattgagatattttataaatagatgcaatatggaatcttatagaattgcctgttagcgttatatagatgaacatgactaattaccctttcatccacgctattagcttccataccatttgcggccattcattaagatccgttgttccttacaataaaaaaattaataaaaaattccctaacatgcagatttagtagttattttaaacaactttagtggaacaaactaaaacatttttaaacagaattttgatagtggcaattaattactaatgatgtgatattaaggtcttaaatgtaagaattcgataaatttgattagacaaagggatccgaagatattttagcgcagtcactaatagggggtacctctgcctacaaaaagcgtttattattaaatgtttaaagatacagtgaagacgacagtcgttaaaacaaatatgatatgaacaatactacatctaagcagcgcaataatactacagcttgaagtatttttcacagaaaaatggtacgtctagttctaacactttcatatctgttcgtcgtttatgcttttagtataaaaactagtgttccggtgtctggagatcatcctacttgcaattgactccaagcacagccatcatggtttgtaagtacattgagactgttacgcttaactggacgaaactcgagaagatatatgattgaccgtaagaccgctttgtttcgacaccatcataatacagtactcataattatcatcatttttttagtccctattacaaagctgccaaatgaataaatctccatcacactctatgaaaatgcacttgatcgtttaattgtagagaaaatttaataaagagaatgttattcaaggcactactgtactaatagagttgggctatatgttaactacaagaatataactttttaataattcggtctatacataatttcgtatcatctgtgtagtgttcaaggcctatagcaattctgttaaatatttatcaaggtaacaccttagaatattatattggactatcgcaatacaaccacttctaccgattaatgcgagagtggccgcgataatcgaaggtatggttaaccgtagtaagtaattctaggcaataaggaatgctttttttttaaatattctttaggacattgtacacctaaattatcaagaataattgttgtaatgacctcgtttgattttgaaaatttgtgtcttaaaaccgtctccgataattatactatactacactttaatcccagatatatcattattaaactatttaatttaatctattcctcaaaccttctattaaatcgtgtcaatcaatatccgccttctaaacggaagtttttcgctaataacaataaacagaattcaaagtcgcttttgtcgtcagcaattttgtttttattatacaggttataatgtagattcgttccgttaaagcgttgtccaattcgataaaaaacatctttttaatttccaggtcaagtttgtgaaagtaaacacgtcgagcaaatacgtataccacacatttgatcacgcagccacatacctctggaaggaagaacgcatactaacgtacctgacgctagtgcaaaacattcaagtaactctgacaatgcgaattgacgagctttaagctcttttatttgctgacaagcattgttgcgaaactagcttgtgctagtattgtctcgtgtgtactattagaagtgaaaaaatcagggataatgtttcgtcggttcacttatatacagatagtgagtgatacttaaacgtatactagcaaaatgacatcttaattaaattatttatcttacatatacttcctagatgacatgaatatgttggtccgatgtacaattgatgttctgatataggataataactgaatcacatatgtattataccaaagtatatacatcacaagttcccgatatcgtttagactactatttactaatcccattgtggaatcttattatatgatcggatagccttgtgttcgtgaagacggcatattaggctcacaccggtgctattaccttccataccagctggcaacaacgattatcatccgctattggataggaaaaaagtatttaaaagaaatcttgtaacaaatgtattatatagtcctaattaactacattactcgagcgaactaaaacttttgaacacaaaaattaagcagaggctaattatgtgatatgatttaaaatttcggtctatatagttataatttgatgaattaaattggattagcagtttgctagataatttggcacagttagttatagacgaaggatttactatgaaaaagcggttttagttatcaatcttagatttcagcgaaagcaggaatcgatgtaactaaagaaatatgtccatcattgcatctaagtaaggcattttgccaaaaagtgaacctatattttgtaaagaaactagaggtcctctttatactctatgatttgtgcagctcttttatgcatatgacgagtaaacaggtgcgtgggtgtatggagaccttcctttttatgtatgattggatggactgcgatcacattttataggttctctgggactgtcacgctaaattgctcggaaattgagaaagtaatcgactatttgtaataacgcattgatcgaactcgagcataacgggtcacacatcataatcttcacttttttagtcccaattattcagcaccgcagtaaatgtataacaatcggccactgtccatttacatatgatcgtattgctttagaattaatttaataaatagaatgtgtaagaaggatctactgtacttatacgaccacgctacatattaacttgaagactatatcctattcttgaccttgtgtatacataatatgaatacgtacatgtaggattcaaaagttatagcaaatctcatgttaaatgtttagggaaaggccttagtattatattctagcctatcggaacacaagcacctttcccatgtaaacccagtgtcatcaccataatgaatagtttgatcgatcgttattgctattagtacatgatgactcgtccttttaacataaattttctactgaatattgattacaaaatgtatcaggattaactaatgtaatgagcccccttgattttgggtactggtgattttatttcgactcagattaacacactaaactaaattttaaagctagatatataaatattaaagctctctatttaacctaatcgataaacaatcaactaaaccgtgtcttactgtgtctgcttcttgaatgatactttatcgccaaagtcaacagttactacctaaagtcgctttgatcctttgctacaccgaattctttatggagagagtaacgtaaatctattttgtagaacgatttttctcttggtcatgaaacatttcattgatctctaagagaaatatgagacactaaacaggtcaagaattttcgtttgctcctcattagtccacgcacccattttcgtttggaagtaaaaattcatattagtctacctgatgctaatgtaaaataccctagagacgctgacagtgccattatgtgagccttttactgttaggttaggtgttgatcaatattgggtgactagctttacctcgtattgcccagagtgtagtatttaaaatgattaaattaggcttaaaaagttgtaacgccatctgcacattgttggctggtgactggtagatgtataataatataaggtattcaaaattgaattatatatcttttgcgttcatcctagatgacatgaatatagtggaacgatgtataattctacattcgatttaggttatgaacaggaactcgtatttaaagtttttatccttgtaaaacctaagtcttcaatatcgtttagggtgggatttgcaaaccccttaccaaaatcataatataggatcggataatcttgtcttcgtggtaagggtacatttgggacgctgaagtagtgtaacttatgaaagaagctaattataacaaaaattatatactagtgagctggaagattgtatttaaaagatgactaataaatattgttatacatgctcctaattggttccatgactcgcgggcaccaaaacccatgacctctaaaataaagctgagtttaaacgcgtgatttcatttaaaatttcaatctgtatgtctattatatccagagatatactgcatttcctattagtttatcgatttcgcatacaatgactcagacgaagaactcactatggaatcggggaatcagatgccaatgatcgttttgatcaaaacaagaaagctatgtggcttaacgaatacttctctcattgtatttagataaaagatcttgctgaaataagatccagtactttgtaaagcaagtagagattcttataatgttctgtagttcatcgggttctaaaaagcaaacgaggactaattaggtgcgtgggtaaaaacctagctacatttctaagtaaaatcagataaactatgataagtttatatgggatccgtacgccagtctgcataatactctgagagaatgacaatccaatccagaacaagctatgagttacagacggttatggagtataacgggtgtcacagcttaaatttagccagtataatccaggagtttcaacattgccgtagaggtgtaacaacccaccactggccatccacatattattatattccataacttttaacttaatttatatgtaacgcgggcaaaatgtattttatttaagtcagcttgctacgttcttagatgtaagcttggttcaatactcgcgcttgaggataaatttcaaaaatagcaagtttttggactctcaaattgttacaaaatgcaccctgtacgtttggggaatggttacaactttatatccttacttgtttagacagaagcacgattcccatgttaatcctccgacttcattacattgaatatacgttccgtttaatattgtttttaatttaaggtcattccatcttctaacactaaatttctactgattatttataacaatatgtaggaggattagccaagatgccaaatgctcgtagttttaggttctggagattttatctcgattcaaatctgcgcactaatatgaattctatagtttgacaagcagataacataggtctctataagacatagagaataattaaatacctagagcatatgttactgagtaaatatcttgactcatatcttagattcctagcccacggttactaggaaggctagtcttgtactttcgatacaccagactgctaatgaagagagttacagaaatcttttttttagggcgacgttatcctaggtcatgattcatatcgtccaacacttagaatattacaaatcttctagttacctaaaatttttgatttgcacctgggtaatctttgcattcgattttagatcggtgtaaagattgatcaaactctatttaatattatccaaatataccatacgcatgggataacacgtattatgaaattctcttttcgttaggttacaactagttcgaaacttattgtttgctaatactacattatcctcacaataccgaatataattggctctttaaaaatcctcatagttgtaacgggaagccgagattattgagtgatcaccagtagctgtactattatataagctattaaaaattgattaaaataaacataccgcccgtattatataaatcatactcagacgaacattgctacaatctgtattcgtaccaagttatgagcgcgtatttcttattaaagtttttgtcgctcacaaaccacagggtttatcaatcatttacgtgggacatgcgatcgtattgccaatgatgaaatataggtaagaagttatctgtctttcttctaagagagcaattaaaaggttgaagaaatgcaatatatatgcaagggaaattaatggataatcttaattcctgtaaggtagtagattgtgatttaaagatgactaaataatattgttgtacatctacctaatccgttctgggctttacgaccaacagtaaccaagacctataaaaaagagcttgatatggacgcgcaattatacttaagatacctagatgttcgtcttttctattcagccaaattctgttacccttttcaatctatggatctcataattaataactcatttatagaagagtatatactatctaaggatggggggccaacgatccttccaatcagaacatcaaagatatctggactgacgttttctcctctcaaagactatagaaaaaaaatcccgctgcattaggatctaccactaagtttacctggttgtaaatcttgcaatgttaagaagatcaatggatcataaaaataaaacgtggaccctttagtaacgaaatctaagatctagacatatttctaactagtctgaacttagattaaacaggtttaataggtacacgaactctgtcgtatataatactttaagtgaaatgttttccagtgttgatcaatctctgaataacaaacgattataatgaaattggagtgtaatcgctaacaacgaccgagagatttttagcagtatcatagttacccctcggctctaataactcactaatggtcatcgatttgataaattgttcgataatttctatctagtttcatttgtatggcggactttataaatttagtatcagtctggttataacgatgttgagcataagcgtggttgaaaactggcgcataaagggtaaattcgaaaacaacgagtgttttgtgaaccatatggataattagagtaccctgtacgctagcatgacacatgcctccataaagccattcttcaatacagtaaaaatagattcattcgtctatttttctatttttttacgttatatttacgttccctttaattacctgctagaattaaggacattccattgtgtaagactgagtttttagtaatttattatattaacttgaagaccaattaggcaagacccgaaaagttggttgtcaatgcctctgaataatttttctaaaactatgcctgggcgttgatagcaatccattgaaacttcaggcagaaaagcttagtcggtttaagtgaatggaaaaacttagaagcgttcagtattgattatcgagcaaatatcttctcatatgtgatagattcccacctcccggttcttaggaaggttaaagatgtaatttctatagacgtgactgcaaaagagaagagttcctgttttcattttttaacggtaacgtgatcctaaatggcgtttttaatggagcaacatatataacgtcggaattcttgtagttatctagtatttttattttgtacataggagatgataattttacattcaagatttgtttcatggttaatcagacttgaatgtaatttctctaaatcatccatgtgctagagacagcatatttaatgaaatagactttacaaaaggtcataattagttagggacttatcgtatgttaatattactctgatctgatatttgcaatcgttgctgtctctctaatattcgtcgtagtatcaatggagaggcgagatcatagtgtgtttaccagcggcaagtctatctaaccagttattagaggtacttgatagcagacataccgcctgaaatatttagatcatagtcagattaaatttactacaactcgtaatcacacgaatttttggcagtgtatttcgcatataagcttttgttgctcacaggacacttggtatacgtaataatctcatgagacatctgatcatactgtgtaccgaggtgtttcgataaatagctatgttatatttatctatataagccgataaaaagacaaatataggcattaaaaatgcaacaaaaattaatgaacggtctcaattactgaaaggtatcactccttgacccaaaactcaaaaagtgatatattcgaactactgatgaaacccatcagggctgttcaatcaagacttacgggagcttattatgaggattttgttacggaccgacaaccgtcgtcacgtaactttgaagtccgtcttttcggatcgaccgaattggttcacctttttgaatcttcgcaagataatactaatagctgctttatataagagtaaacactgtctataggtggaggcctatgagtctttccaatatccttattaatgataattccactcatgtcacctctactatagtacaaatgtattatactgccattgcactagaacttacggcaaatactgtctcattacataaattgcagcctcaaggacatcaatagatgataaatataaagcttatgtcctcaattgtaaaattgtaagttcttaacaaagtacgtattagtcagaacttacattaatgagattaagtacttacacagtttctgtcatataaattagttcatttcaaatctttttccgtattagtcaatgcctcaataggatagaattataataagactatattataaacgttagcgacgacagagaggttgtaagcggcattatagttatctctccgttcgagaacgatataaaaagttcccgtacagattgataggttagtattctccctgagctatcgtctgcatgacggactttatagtagtacaatcactttaatttaattcatggtcagcatttctgtgctaaaaaatcgtcaaataaagcgtatattcgaatacaatgaatgtgctatgaaccataagcattactagagtactccgcagacaactatgtcataaggctccgcgacgcaatttaacgatactatatcaataaaaataatcagctatttttctgtttatatcgctaatttttacgttgtttaatattgcttgccagagtttatcatcttttatagggaggaggccggtagaggattttacggtatataagcctaatgactactacgagtagtcccgtcaaaatagatcagagtatccacaaataaaactccaataacaatggctgactcttggcagcacagcatcgaaacttgaggcacaaaggcctaacagactgaaccaagtggaaaaactaagaagcatcctaatatgattaactgtgaataagattttcatttgtgagggatatccatcaccagttactcaaaatcgtaataggaataataactattaaaatgagaacagtgtacataatgtcatgcttgaataatatggtggtatggtgatctagaatacctcttatgagagagttatgtatttaacctgggtgtctctgttcatatctactatttgtatctctaatacaggagttaacatattaacactcaagaattgtttcttccatatacagttatgtaagtgattactgtaatccataaacctgtcaaagtcactatatctggttaagtaaagtctagagaaatgcataatcaattacggagttatctcaacttagtataattgtgatataatgtttgcagtggctgctgtctctccaactttcgccgtgagatgattaaacaagtagactcttgttatatattacaaggtcatgtctaactaccctatcacaagagcgatccgacaggtgaggtattagcaggaatatcatcatgtcagcgtaattaaattatgcaccagtcgtaaaatcacggtttattagcagtttaacatgcgtatagtctaaccctacatacacgatacctgaaaatcgtaatgatcttagtaagggattgttaaaacggtattccgaggcggtgcattaatttgctatggtatggttattcttattacacggtttagaaacaattatagtggctaagaatgcaactagttattacgaacggccacgaatagtagaaaatttccttcctgcgggcttctcctgaaatgccatttatacgggttattgaagccggttactacgacagatttattcaacctcaaaggtctatattcccagcttattcttagccgatatgttgcgtcgtgtcccagctttgaatgcgttaacaccggattgtctgacttagttcagcttttggatacctcatcgggttatactaactgacacttattctttaaataaggatcccttattgggagtggtaagtgagatttgggattatccttatttctaatgatcttacccctttcgcatgaataacagtacgagcttattttacgaggatatcacttgatcaagtggaggatactcttccaattcttgaataggacctagagagttgaatgtattagatggacgtacgcattatgtgctcagttgtataattgtgtgttttcaaggaaggaagtatgcgtcaattcgttcagtatcgacataaggtatttggaaagttttagtgacatagaccaatagattttagatctctttacccatcagtaaataccattatagagtcaattcaaatttacgctatttaacacacaacgccgaggataaaagggctgaaattgacagtctactattttgttcatgtgtgaacaattaacaatattcgaatacacgttgatgcgatagtgctctggctaggctgtccacttcgtatattttctttgagtagtgcagacgtattaatataatatgtagccaggatcttagcatgaaacgatgattaaaatgtacgcataccacgttgggatgtatgtgctatagacttttagtattacctgaaacatagtccatcgattttgccataagacttcggcacgaaattaagtgatttcacacctacaagagaaatgtgccgaatctatgataatatcaccgttcgttgtattaatcaataatggtagcggctgcatattatcaaatgaaggagcgacacccggggaggagtttacggtggatatcccgtacaacttcggctaatcatgttatctaaataagttggggtttgcagttatgagggcgaaatcagattcgactatacagcgcagttcagagccctaactcacgtaatcgtgaccttacagagcgagtcaagttgataacctatcgagtagctcaatatgagtgagtgtgaataagaaatttattgcaaggcaataatcctaatcattgacagcaaactttgataagaataaagattagtacaattcagaaagcgtacttactgtcatactcgaatgaaatgctttattaaagaaaaagttgacgtcctatgagaagattaagaacttctcctgcatctcacaacttacataatcttcgggcatgggtaatagataggtgaacatataaatacagaaaagtttctaccttcatacgtagttaagcaagtcatagctatatcccataaacctttcataatcactgtatcgggttatctaagaactaatggtatggctagtcatttatggtaatttgtcagttaagtcaagatgcggtaaattgtgtattgcggctcctattatcccgacttaaactgtctgatgttataacaaatacacagtagttaattgttatttgcttatgtactgctacgctttgtggagaccggtccggcgcgtgaagcatataaatgaaactcatcacatccacataattatatcgtacatcggtgtaggaatcgaacttggcttctaattttacatgcgtgcgctgcaagtgtaaatataccaaatctaaaaatcacgatgggctttgtttcaggtatctaaaaggaaattctgatgccgcgcttcaattcactaaagtgtggatgttctctttatacgggtttgatacttttattgtagcaagcatctttattagttaatactatccccaacgtataatagtttacttcctcggtgtgggcccctcgtcaagtgcctgctatagagcatgttgaagccgattagtataatagattttttcaactccaaacgtcaacagtcccgctttagtttaagttcatatatcgggacaagtctcggaattaagtgcataagcgctgggatctttcgcgcagttcgaataatgagtaactgatcgagttacacaccgtcagacttattcttcagataacgttccgttattacgattaataactatcgtttgaaactattccatcttcttaacgtgttaagtctttcgcaaaaaagacggtatgagcttaccttacgaaataatttcttttcgaactacagggtgctctacttgctcttgaagaaatcgtagagtgttggatgaattaaaagcccctacccattttctatcgacttgtatgtttatccttattctaacatggaagtttgcattgatttgtttagtatcaattaggcgtgtttcaaatgtattaataagaatgccgtatagattctccattaccgaactgaacactacttagtattaaacagtcattgctgttctacgccatttaagacattacgctcaaaataactgagctgaatttcagagactataatattatttatgtgtcaccaattaacagttaacgaatacgtgacgatgtggaacaccaggagccaggtcggacgcatcctatatttactttgtgcagagtaggtctaacaaaatagcatgtaggtttatgcttaagttgaaccgcagataaaggtctatactcgggatcttcactatctgaaggtttagatttttaatggtaccctaaacaaagtgcataggtttttcattaaaattatggcgcaaagctaagtgaattcactcctacaacagaaatatgaccaaagtatcaaaacaacatggttcgtagaaaaaatcaatcgtgataaaggttggattttgacaaaacaaagagccacactctgggagcagtcgacggacgtcaccacgtgcattttcggctaatcttataatctataaatgttgaggtttacagttctcggggcgagatcaaatttaagtatatagtcgtatccgaagcgttaaatcacttattcgccatgcttgaaagcgcctcatgcttttcactgattcattagctctatgtatggcaatctaagtacgaagtctgtcgtaaggcttaaaaactaaatattggtagctaccttagttaaggtacaaggattgcacaattcagtaggcgttttttctgctattctcgaacggaaagctttattaagacaaagcttgatatcccacgggatgaaccagaagttctatgatatctcagaagctactaaatttcgggggttgggtacaagttagttgaacatacaaataggaatttgattgtatccttagtcgattctaaacaaatcatagtaaacccgtgcaaagtatacatattaattcatacggcgtttcaaagaggcaatggcttgacttgagctgaattacagattatgagtaaccacaagatagagtaaacactgtaatccatgtttaattgagaccacttaaagatgctgatattattttcaaaacacaatggtttattgacaattatttatacactgatacatcttgcggttcttggtcgaccctacttacgatataaatgaagcacgtttcatccagattcatctatcgtagctccaaatacgaattcaacttggcgtttatatccagaaaagagccctagaggtgatagacttttaagtctttggactaccatgggatatgtttcacgtatcgaaatagtaattattattctgcgtttgctttcatataagtgaggatgaagcctttatattggtttcttaatcttcttataccacgcgtgtatctttcctagccctttattgaatctggaagtgtcttgttactcaatgtcaaacccttgtcagcctcttgcggtgatgcacgaaaaaaccgaatggaatataaaatattaactactcctaattttaagtgccctcttctagattgaattcatatatcaatatagacttcgcaaactagtgaatgaggggtatgaatttatccggaataacaaaagggactaagtattcgagatacaaaccgttagatagatgctccagtctgcatagtgaatttttgatttttaaccattgaaggaatcaatttcacgatccttacgagttaagtcatcagaaaaagagaccattagcgctccccctttgaaatagtacagtttcaaacaatagcctgagtaagttggtattcgagatactataaacttttcgatcatttgatgcccccaacctatgtttaaagaactattatctttagccttaaactaacacaggaaccagctaagtcttgtttagcttcacttgggctggttacatatataaaataatgtatgccgcagaatttgtcccttagcgaattgtagttgaccaaaagtctattactcattggcgttgtatcacttttgtgtcaataggtatgattaatctcttgaaaatttttacgacaatggtaaaagattagaactactaaacaactgttaataatcatgtcgctccgtagattgccaagaatcagttgggatgaatacgttatttacaacgtacaaactacgactgagttggtaccatcgtagtttatgcctatgttgaaccgcaattatacgtcttttgcccggatccccactatctgtgaaatgtcaaacctgttcgttacctttacaaaatacatagctatatcatacgtaaaaatatgttaacgaaagatcgttcactctttcttcggaaagataaccaaagaattaggaggatatggtgcgcacatagaaagggccggtaagtaactctggccttcatagaacaatatgttataatttggaaattgtcggatagcgcgactatgtgcttaattggtttaccttaaattttataattgatgacaataaaaattcaccggagaagttctaacgtaagtatatagttataactgaaccattcgaagacttactcccttaacttaattagacctatttgttttccctgactcctaagttctatggttggcaatttatctacaaggagacacgtatcatttaaaaacaaaaaattggaaacttccttagctgttgtgctgggaacgctcaaatcagtactcttcttctctagaagttgcaaggggggaattttatcatgtcgaagtttgttataggagtcattcaaccataggctccatgatactaaaagtgctggtaaactacgggagtaagatacatatttctcgataatagaattcagaattcgaatgagtccttggtcgactcagatccgaatcgagagaacccaacgaatatataatttttattacatatgttgtcttagacagagtattccttaacatcaactggttttcagataataagtaactgcaacagagtcaaatcatagatattgatagtagttagagaaccattgataatgttacaaccattttctaattttgatgttttgtagacaattattagttcagcgagctatctaacagttcttacatatctctactcatgcaataaattctgcaagttcgacactaactcaacctaggtaacatcaaatacggatacattcaggggttattatgcaaaaaatgggcttagggataatagacactttacaaattgcgcatgcaatcgagatattttatgtatcgatataatatgcatttttatagaattgcctcctagcgtaacataaacaaacctatctatttgcttttttatccacgcatattacgtccgtaccatttccggccattcattaagatcggaagtaccttgttatacaaaattaaacctttaataccctatcgcgcagatttaggaattaatttaatcaactttagtggatcaattatagacatttttaagtggtttcttcaaggtagcatttaaatatcaatgatgacttactaaggttctaaatgagagaattcaattaatctggttagacaaagggatccgaagatattttatgccaaccattaaaagggcgttcctctgtctacaataagcctttatttttaaatctttgaagaaatcgagaacacgactgttgtcaatacaaatatgataagaagagaacttcatctttgccccccaataatagtacagcttcaaataatattcacagtaaaatggtatgtctggtactaagactttcatgactgttcgacgttcttattttatgtataaagagtagtgatcccatgtctggagattattctacatccaattgactctaagcacagccttcttgggttgcttgtatattgaaaatgatatactcaactggacgagactcataaggaattatgattgaccataagaccgctatgtatcgacgtcgtcttagtttagtactcataattatcatcattcttttagtgcctattacaatgttggtaaaagaataaaactgcatcacacttcttgataatgaacttgctcgattgattgttgagaaagtttagtgatgagtatgttatttaaggcactcgtgttctgatagagttggatccattgttaattacgagtatataactcttcaataattcgctctatacgcaaattcctattatctgtgaaatgtttaacgcgtacggtaactctataaaatatttatctacgttataccttagaatatcttaacggacaatcgcaatatatctacttgtactgattaatgggaaagtaggtgcgaatattgaaggtatggtaaacgccggtaagtaattctaggcaacaaggaatgttatttttttaattatattttaagggattgtacgtctaaatcattaataaaatttgttgaaatcaccttgtttgaatttgtaaaaattcgtcttaaaactttcaccgttaattaatgattactacagtataattccagaatttacattcttaagctaattaaactaatctgtttccctaggcttctataaaatcgcgtcagtgattatcccccatggagacggatgtttttcgcaaataataatttacaaatttctatgtcacttctgctgtcaacagttttgtttatactattcttgttatgatgtagattcgtcgcgttattatcatgtcgaacttcataaaaagtgtctttttaccatgcagatcaagattctgaaagtacagacaagcagcaaatacgaaattcatatttttgatcacaaggccacagacctctagtaagatgtacgttaactgaggttcgtgtcggtagtaccaaacgttcatgtaactctcacaatgcgaattgacctgctttgagctcttctatatactaactggtattctggcgaaacaaagctgtggtagtattatgtcatgagtattaatagtagtaagaaaatcagggataatgtttcaacggtttacttatttagaggtagtgtgaggtacttttacgtgaactagcaaactaacatctcttttaaattattactcttacaataagttccgtgacgacatgattatctcaacctgatatacaattgatgttcttatattgaaaagttattaagcgagatatgtatttaagcatagtagacacatcacaagttgcggatatcattaagacaatttataaatagttccattgtggaatcttataatataacctgatagcgttatattggtgaagatggctaattaccctctcaccggcgctattagcttccataccaattggcgccattcattaagatccgttgttccttacgaaaaaaaaatttataagaaatcctgtaacatgcggatttagtagtttttattaacaacattactggagcaaactaaaacatttaaagacagaattttggcagaggcaattaatatcatatgatgtgaaattagggtctatattgtaataatttgataaattaaattagataaggggtttggaagataatttagcacagttagttataggcggaagatttgccttcaaaaagcgattattgttatttgtcttaagttacagcgaaaacagcagtcgttaaaacaaaaatgatatgtccaatattacatctaagcaaggcaatttcgcaacaggttaaggtattttttatagaaaaattaaaggtccagttcaaacactttcatttgtgtagctcgtttatgcatatggtatgtaaactagtgcgtcggtgtatggagatcttccttcttgcgtatgattgcatggactgcgatcacgttttgtaagttcattgagactgttacgcttaactgctcgaaattcgagaaaatatacgactgttcgtaagagcgctttgatcgaacacgatcataacagagcacacatgataatcatcacttttttagtccctattacaaagcagccaagtgaatatatgtctatcactcactatgaatttgcatatgatcgttttattgtagaaataatttaataaatagaatgttaatgaagggtctactgtacttatacaattgggctacatgttaactacaagactatatcctattattgacttagtgtatacataatatggtttcatatatgtagtgttcaagggctatagcaaatctgatgataaatgattagggtaacaccttagaataatatactagcctatcggaacacaagcacttctgccgtataatccgagtgtggccacgataatggaaggtatggtcgaccgttgttgctaatagtaggcgataacctatccttttttcataaattttctttagaacattgttcacataatatatcaggattaattgatgtaatgagctcgcttgattttgaaaacttgtgtttttaattcgtctccgattaatacactatactaaattttaaagccagatatatcaatattaaactatttaatttaacctaatcctcaaacgttctattaaaccgtgtcaatcaatatctgcttcctaaatgaaactttttcgccaaaatcaatagttagaatctaaagtcgctttcgtccttagctatattgatttctttatacaggtagtaacgtagattcattccgtaaaacggtttttcatttggatataaaacatttctttgatctccaggagaaatatgagaaactaaacacgtcgagtaaatacgtatactgctcatttgtccacgcacccacatacctctggaaggaaaaacacatactaacctacctgacgctagtgtaaaatatccaagagaccctgacagtgcgatttaacgagcctttaactctttcattagctgataagcattattgcgaaactagcttgagcttgtattgtccagtgtgtagtattagaagtgaaaaaatcagggttaataactcgtggcgtcatttacatactgttagccagtgacaggtaaacgtatactagcataacgatatcttaattaaattatttatcttacacattcttcctagatgacatgaatatgctggtgcgatgtataattgaacttctgatataggataagaactggaacacatatgtattatactaatgcatgtacatcctaagttttcaatatcgtttagagtacaatttacaaatccctttccggaatcataatataagatcggatagccttgtgttcgtggaaagggcacattagggtcacagtggtggtattacttatcaaactagctagcaataacgataatcatgtactactgaacaggaaaattgtatttaaaagaagacttataactaatgttttacatagtcctaattgattacattactcgggggaactaaaacccatgaccactaaaataaagctgagtctaattatgtgatttgatttaaaatttcgatctatataattataatttcgagagataaattggattagctatttgctagatgatttggcacagaatgacacagacgaagaacttactatgaaatagcggtttcagttgtcaatgatggatttcagcgaaactaggaaacgatgtagcttaagaaatatctctctcattgcatttagataaagcatcttgctaaaaagagaaccagtactttgtaaagtaactagaggttctctttatactctgtgatttgtccagttcttaaaagcaaacgaggagtaatcaggtgcgtgggtaaaagcagaccttcatttttaagtatgattagatggactacgattacattttatgggatctctgcgactgtcacgctaaaacactcggaaaatgacaatccaatccacaactagttataacccactgatcgaaatggagcataacgggtcacacatcataaatttcactattttagtccgaatttttcagcattgcggtagatgtgtaacaaccgaccactgaccatctacatattattatattccataagatttaacttaatatatagaaaacgcaagtaggatctactgtacttatatcaccatgctacatattaagatgtaagctaaatccaattcttgtccttgagcatatatatcaaaaatacgaacattttggattcaaaagttatagcaaatcccaccctaaacgtttggggaatggttttagtattatattctagcctattagaacagaagcaccattcccatgtaaacccagcgtcttcatcacattgaatactttcatcgattaatattgtttttaatatatgatgactcgaccttctaacataaattttctactgattatttataacaatatgtaccaggattaaccaaggtactgagcgcccatggttttgggtactggtgattttatttcgactcaaatttgcgcactaaagtaaattttaaagttagacatacagatattataggtctctatatgacgtaaacgataatcaaatagctaaaccgtatgttactgagtctgcttcttgagtgatactttagccccttagtctacggttactagcaaaactagttttgttctttcgatacaccgaattgtttatgaagagagtaacataaatctattttgtagaacgactttattctaggtcatgaaacatttcgttcatctctaagaatattacaagacatcaagtagcccaagatttttcgtttgctcctgattaatccacgcacccattttcggatcgatgtaaaaattcattttagtctatttgatactattcaaatataccctaggcacgcagtcagacgcattatgagactcttttactgttaggttaggtgttgttcgatactgggtgtctgccaatacctcatattgcccacagtgtcgaatttaaatcggtcaaattaggtcctcaaagttgtaacgccatctccacattgttgggtggtgaccggtaggtgtataataatataaggtattgaaaattgaattaaatatactttgcgcccgttctacatgaaataaattcagtcgaacgatgcaagaatctacattcgaaccaagttatgagcgcgaactcctatttaaagtttttatcgttcaaaaacctgagagtttaacaacgttttacgtgggacatgcaaaccccttaccaatgtcgaaatataggaatgaacaaatctgtcttcgtgctaagggtacaattaggacgctgaagtaatgtaacttatatgcaaggcaaattataacaaaaattaaattccagtaaggtggaagattgtgatttaaagatgactaataaatattgttatacatcctcctaatcggttctacggtttacgagcaccaaaatccaagacctctaaaataaagctaagtttagacgcgtgattatacttaagatatcaaactgttcgtctattatatccagagatattctgtatctcttattaatttatcgatctcgtatacaatgactcatttatagaactcagtatagaatctaaggatcgggtgccaatgatccttccgatcagaacatgaaagctatgtggtctgacgattacttctctcaatgtctttagaaaaaaaatcccgctgcaataggatccagtacttagtaaagcaggttgtgaatcttataatgttttgaagatcattggattttaaaaaccaaacgtggactgattagaaacgtaagctaaaatctagccacatttctaactagtttcagataaattataataggtttatatggtatgcgtaccccattctgcataatactttaagagaaagacaatccaatgttgatcaagctttgaattacaaacgattatgatgtaataggggtgttatggcttatattaagccagaaatttttaggagtatcaacattgcccttcggctctaataactcactagtggtcatcgacatgataatatattcgataatttttaactaattttatttgtatggcgggcataatatatttagtttgagtctgcttgcaacgatgttagacataagcttggttcaatactcgcgcttaaagaataatttcaaaaacagcgagtgtttggtgtcccaaatagttactaaatgcaccctgtacgctagcataacggttactactttatatccattcttcaatagacagaaagaagattctctcgttaattttccaacttctttacattgtatatacgttccctttaatttcctattagaattaaggacattccatcatctaacactaaatttctactgatttattataacaacatgtaggtggattaggcaagacccgaaatgctggttgtctttggttctggatattttttctcgaactatatctgcgcgttaatatgaattctatagatctacaagcagaaaagataagtcggtttaagacaatgggaaaagttagatacctagagtattaattattgagtaaatatcttctcatatatgatagattcctaccccccggttgctaggaaggttagtcttgtagtttccatagacctgactgctaaagaagagagtttctgatatcttttttttagggcgacgtaatcctagatggtgattcaaatggaccaacatttagaacattacaattcttctagttacctagtatttttattttgcacctgggaaatcattgcttttgattctagatctgtgtaaagattgatcagacttgaattaaatttgtccaaattatccatgtgcatgagacaacatatattatgaaattcacttttcaaaaggtcacaactagttggagacttattgtttgctaatattacattatcctcacattagcgattgtagttggctctctaaaaatcgtcatagtaccaatggggagccgagattattgagtgattaccagtagctaaactatttaataagctattaaagattgatcaaagtaaacataccgcctgaaatatataaatcatagtcagaccaacattgctacaattcgtattcgcaccaacttttgaccgcgtatttcccatttaagcttttgttgctcacaaaacacttggtatacctatcaatctcatgggacatgcgatcgtactgtgtacgaaggtatttcggtaagaagttatgtcacttttatctaagtaagcaaataaaaagataaaaaaatgcaatatatatgcaagggaaattaatggacgatcttaattcctgtaaggtaacacattgtgactcaaaaatcattaaataatataattgtacatctggctaatccgttctgggcttttcaaccaacagtaacggagacttattaaaaagattttgatacggacgcgcaactattgttaggtaactttgaagtccgtcttttcgaatcagccaaattcacttacctttttgaatcttcggatgtcataattaatagctcgtttatagaagagtatacactatctaagggtggagggccaagaatccttccaattactacattaaagatatctgcactgacgttttctcttctcaaggacaaaagtaaaaaaatgccattgcactaggatttaccgcaaagattacctcgttgtatatattgcagtcttaagaacatcaatggatcataaaaataaaacatgcatcctttactattaaaatctaagttctagacaaattaccaattagtctgaacttacattaaagagatttaataggtacacgatctctgtcgtataaattactttaactgaaatgttttccagtattaatcaatccctgaatagcatacaattataatgagactagactataaacgttagcaacgacagagagattattagcagcatcatagttacctctccgctctagtatcacacaaatggtcgtcgatcagatagattggtcgataatctccatgaactatcgtctgtatggcggactttataaatttagtatcagtctggtttaaatgatgttgagcattagtgtgcttaaaaaccgtcacataaagcgtatattcgaaaacaacgagtgtcttgtgaaccatatgcataattagagtactctgtagactagtatgacacatggctccacaaagctatttatcgatacaatataaatagatatattcggctatttttctgtttatatccgtaatatttacgttgtttttaattacttgccagagttaaagacattccatagtgtggaactgggttttgagtttttcactatataaacttgatgactactttggctagtcccgacaagttagttctgaatgccctcgaataatacttctaaaacaatgcctggctgttgacagcagtgcattgaaacttcaggcagaaaagcctagccggcttaaccaagtggaaaaacttagaagcgttctattatgattatcgaggaaatatattctcatttgtgacagatttccacctccggatacttagaaaggttataggaataattactattgaggtgagtacagtggagatgatatcatgtttacattatatgacggtaacgtgatcctgaatgccgtttatgatagagtaatgtatttaacgtcggaattcctgtagttatctagtatttatatttcgaatataggagataacattttaacattcaagaattgtttcatgcataatcagtcttgaatgtaattactctaattcatcaatgtgtcaaagacagtatatttaatcaagtaaagtttagaaaaagacataatcagttacggagttatcctatcttaatattactctgatgtaatatttgcaatcgctgctgtctctccaacattcgccgtaatatcaatagagaggcaagctcttgctatgtttttcaagggcatgtctaactatccaatcataagagggactcgatagcagacgtactgcctgaaatatcatcatgttagtgaaattaaattaagtaccagtcgtaaagacacgattttttagcagtttatttcgcatataagcttttgttacttacacgatacttggtattcgtaatgatctcatgaggcgtctgttcatactgtattccgaggcgctccgataaattgctatgatatagttatttatattagtcgataaaaagacaaatatagcgattaaaaatgcaacaaatattaacgaacggtctcaaatagtagaagatatccctcctccggccatctcctaaaatgccatatattcggattactgatgatgctcatcagggcagttttatctagtcttataggtgtttattttgaggttattgttaccgaccgagaaccgtcgtgtcgtagctttgaactccgtgtttccggattgtctgacttggttcacctttttgaatcttcgtaggattatactaattgacactttttctaaaagtaaacactccctataggtagtggtcaatgagtttttgcattatccttattattgataattctactcttgtcacgtgtattacagtacaaacttattataccaccataccactagatcttatggagaatactctctcaatacataaattggagccacagagacatgtatagatgataaatatagagattatgtcctcaattgtataattgtgagttcttaacaaagaaggtatatgtcagaactttcactaatgacattaggtatttggacagtttcagtgatatagattaattcatttcagatctttttacgtattagttaatgcctcaatagagttgaattataataacactatattataaacgtcagcgacgacagagaggttgaaagcggcattctagtaatttgttcgtttgagaacaatataaaatgttcctgtacagattgatgggatagtgttctccctaggctgtccactccataatcgtccttatagtagtacagtcgctttaatttaatacgtggtcagcattttagtgccaaataatcgtcaaattgaacgcatatcagattgcgatgtatgtgctatggacctttagcattactagaatcattcccaaacaattttgccataaggctccgccacgcaattaaacgataccataccaataagaataatgtgccaaatctttgttaatatcaccaattcttacgttgatcaataatgcttgccggagcttatcatcttttaaaggaaggacgcccgaagaggactttacggtaaatatgcccaataacttcggccaatgatgctgtctaaataggttggagtttccagatataaggctcgaataagaatcggttatacaacgcagcacagggtcgaaacttacgcaattgtggcctaacagactgaatcaagtcgaaaatctaaggagtaacccaatatgattgactgtgaataagaaatttattcctggggaataaccctcaccatttactctaaaccctaataggaataaagattactaaaatggggagagcgtacttaatgtcatgctcgaataaaatggtcctatagtgaactagttcacctcctatgagaaagttaagaacttaacctggatgtctctacttacataatctacctgcatgcgtaatacacgagtcaacatattaacacacaaaagttccttcctccatatgcagttaagcaagtcatagctgtattccataaacctttcaaagtcactgtatctggttatctaaagtctagagaaatgggtagtcatttatggtaatatctcaattaagtttaaatgcgataaattgtgtaccatgctaatctatgacgacttcgactctcttgctgaaattttccacttccttatgtggcctgacgaatacttctctcattgtttttagataaaagatcttgctgaaataggatccagtactttgtaaagcaagttgagaatcttataatgttttgaagatcatcgggttctaaaaaccaaacgtggactaattaggtgcgtgggtaaaaatctagctacatttctaagtagtttcagataaattatgataagtttatatgggatgcgtacgccagtctgcataatactttgagagaatgacaatccaatctagatcaagctatgaattacaaacggttatgaagtaaaacgggtgttacagcttaaatttagccagaataatttaggagtttcaacattgccgtagaggtgtaacaactcaccagtggccatccacatattaatatattccataacttttaactaattttatttgtaacgcgggcaaaatatattttgtttaagtctgcttgctacgatcttagacataagcttggttcaatactcgcgcttaaagaaaaatttcaaaaacagcaagtttttggactctcaaattgttacaaaatgcaccctgtacgttaggggaatggttactactttatatccattcttgtttagacagaagcacgattcccatgttaatcctccaacttcattacattgaatatacgttccctttaattttctatttgatttaaggtcattccatcatctaacactaaatttctactgattatttataacaatatgtaggaggattaggcaagatgcgaaatgctggttgtttttggttctggacattttatctcgaattaaatctgcgcattaatatgaattctatagattgacaagcagaaaacataggtctctttaagacaatgggaataattaaatacctagagcataaattactgagtaaatatcttgactcatatcatagattcctagcccccggttgctaggaaggttagtcttgtagtttccatagaccagactgctaaagaagagagttactgatatcttttttttagggcgacgtaatcctagatgatgattcatatggaccaacacttagaatattacaaatcttctagttacctaatatttttgatttgcacctgggaaatcattgcattcgattttagatcggtgtaaagattgatcaaactccatttaattttatccaaatttaccatatgcatgggataacacgtattatgaaattcacttttcgttaggttacaactagttcgagacttattgtttgctaatactacattatcctcacattagcgaatgtaattggctctctaaaaatcctcatagttgtaatgggaagccgagattattgagtgatcaccagtagctgtactattttataagctattaaaaattgattaaaataaacataccgcctgtaatatataaatcatagtcagacgaacattgctacaatctgtattcgtaccaagttatgagcgcgtatttcttatttaagtttttgtcgctcacaaaacactgggtttaccaatcattcacatgggacatgcgatcgtactgcctatgatgatatattggtaagaagttatctgtctttcttctaagagagcaattaaaaggttaaagaaatgcaatatatatgcaagggaaattaatggataatcttaattcctgtaaggtagcacattgtgacttaaaaatgactaaataatattgttgtacatctagctaatccgttctgggctttacgaccaacagtaacgaagacctattaaaaagaccttgatatggacgcgcaactatagttaagttacctagatgtccgtcttttctattcagccaaattctcttacctttttcaatctttggatctcataattaatagctcgtttatagaagagtatatactatctaagggtggagggccaaggatccttccaatcacaacatcaaagatatctggactgacgttttctcctctcaaggactatagaaaaaaaatcccattgcattaggatctaccacaaagattacctggttgtaaattttgcaatgttaagaacatcaatggatcataaaaataaaacgtgcatcctttagtaacaaaatctaagatctagacaaatttccaactagtctgaacttagattaaagaggtttaataggtacacgaactctgtcgtatatattactttaagtgaaatgttttccagtgttgatcaatctctgaataacaaacgattataatgaaattagagtgtaaacgttaacaacgaccgagagatttttagcagcatcatagttacctctcggctctagtatctcacaaatggtcatcgatttgataaattgctcgataatttctatgtactttcatttgtatggcggactttataaatttagtatcagtctggtttaaacgatgttgagcataagtgtgcttgaaaactgccacataaagggtaaattcgaaaacaacgagtgttttgtgaaccatatgcataattagagtaccctgtacgctagcatgacacatgcctccacaaagctattcttcaatacagtataaatagattcattcgtctatttttctatttatatgcgttatatttacgttgtctttaattacctgctagaattaaagacattccattgtgtaggactgagttttcagtaattcattatattaacttgaagaccaattaggcaagacccgacaagttggttgtgaatgcctccgaataattcttctaaaactatgcctgggtgttgacagcaatccattgaaacttcaggcagaaaagcttagccggtttaagtgaatggaaaaacttagaagcgttctgtattgattatcgaggaaatattttctcatttgtgacagatttccacctcccggttcttaggaaggttaaaggtgtaattactattgacgtgactgcagaggagaagagatcttgttttcattttttaacggtaacgtgatcctgaatggcgtttataatggagcaatatatttaacgtcggaattcttgtagttatctagtatttttattttgtatataggagataataattttacattcaagatttgtttcatgcttaatcagtcttgaatgtaatttctctaaatcatccatgtgccagagacagcatatttaatgaaataaactttacaaaaggtcataattagttagggagttatcgtatgttaatattactctgatctgatatttgcaatcgctgctgtctctccaatattcgccgtaatatcaatagagaggcgagatcatactgtgttttccaacggcaagtctatctaaccagttattagaggaacttgatagcagacataccgcctgaaatatttacatcttagtcagattaaatttactacgactcgtaaacacacgattttttggcagtgtatttcgcatataagcttttgttgcttacaggacacttggtatacgtaatgatctcatgagacatctgttcatactgtgtaccgaggtgttccgataaatagctatgttatatttatctatataagccgataaaaagacaaatataggcattaaaaatgcaacaaatattaatgaacggtctcaattagtgaaaggtatcgctccttggcccatatctcaaaaagcgatatattcgaactactgatgaagcccatcagggctgttctatctagacttacgggagcttattttgaggtttttgttacggaccgacaaccgtcgtgacgtaactttgaagtccgtctttccggatcgaccgaattggttcacctttttgaatcttcgtaggattatactaatagttgctttttgtaaaagtaaacactccctataggtggtggtctatgagtttttccattatccttattattgataattctactcatgtcacctctactatagtacaaatttattatactaccattgcactagatcttacggcgaatactctctcattacataaattggagcctcagggacatcaatagatgataaatataaagtttatgtcctcaattgtaaaattgtaagttcttaacaaagtacgtattagtcagaacttacattaatgacattaggtatttacacagtttctgtgatatagattagttcatttcaaatctttttccgtattagttaatgcctcaatagaatagaattataataacactatattataaacgttagcgacgacagagaggttgaaagcggcattctagtaatctgtccgttcgagaacgatataaaatgttcccgtacagattgataggttagtattctccctgagctgtcgtctccatgacggactttatagtagtacaatcgctttaatttaatacatggtcagcatttctgtgccaaaaaatcgtcaaataaagcgtatatccgaatacaatgaatgtgctatggaccataagcattactagaatactccgcagacaactatgtcataaggctccgcgacgcaatttaacgatactatatcaataaaaataatcagctatttttctgtttatatcgctaattcttacgttgattaatattgcttgccggagtttatcatcttttatagggaggaggcccgtagaggattttacggtatataagcctaataacttctaccaatggtgccgtcaaaatagatcagagtatccagaaataaaactccaataagaatggctgacactaggcagcacaggatcgaaacttacgctacaaaggcctaacagactgaaccaagtggaaaaactaagaagtatcccaatatgattaactgtgaataagatattcattcgtgaggaatatccgtcaccacttactcaaaaccgtaataggaataataactattaaaatgaggacagcgtacataatgtcatgctcgaataatatggtcgtatggtgaactagaatacctcctatgagaaagttaagaacttaacctgggtgtctctgttcatatcttctatttgcatctgtaatacaggagtcaacatattaacacacaagagttctttcttccatatgcagttatgtaagtcattgctgtattccataaacctgtcaaagtcactatatctggttatgtaaagtctagagaaatgcatagtcatttatggaaatatctcaactaagtataattgtgataaaatgtatgtagtggctgctgtttttccaactttcaccgtgagatgattaaacaagtacactcttgttatttattataagctcatgtgtaactaccctatcacaagagcgatccgacaggtgaagcattaacaggaaactcatcacgtcagcgtaattaaattatacaccagtcgtaaaatcgcactttattagcagtttaacatgcgtatagtctaaccctacatacacgatacctgaaaatcgtaatgaacttagtaacggatagttaaaacggtattccgaagcggtgcattaattcgctaaggtatggttgttcttattacacggcttagatacaattatagtggcaaggaatacaattagttattaccaacggcgacgaatagtagtttatttccttcctgcgggctcctcctgaaatgccacttatacggcttattgaagccgattagtacaatagatttattcaacctcaaaggtctatattcccggcttattcttagctgatatgtcgcgtcgagtcccgggtttgagtgcgttaacaccggattgtctggcttagttcaacttttggatacctcatcgggttatactaactgacacttattctttaaataaggttcccttattgggactagtaactgagatttgaaattatccttatttctaatgatcttaactctttcgcatgaataacagtacgagcttactttacgaggttatcacttattcaagtgcaggatactcttccaattcttgaaaaggacgtagagagttgaatgtattagatgggcgtacgcattatgtgctcacttgtataattgtgtgttttcaaggaaggaagtatgcatcaattcgttcagtatcgacataaggtatttggaaagttttagtgacatagtccaatagatttttgatctctttaccgatcagtaaataccattatagagtcaattcagatttacgctatttaacacacaacgccgaggataaaagggctgaaattgacagtctacaatattgttcatgtgtcaacaattaacaataaacgaatacacgttgatgcgatagtgctctggctaggccgtccacttcgtatattttctttgagtagtgtagacgtattaatatagcatgtagccagattcttagcatgaaacgatgattaaaatgtacgcataccacgttgagatgtatgtgctatagacttttagtgttacctgaaacatagtccatcgattttgccataagactacggcacgaaattaagtgatttcacacctacaagagaaatgtgccgaatctatgataataacaccgttcgttgaattaatcaataatggtagcggttgcatattatcaaatgaaggagccacacccggggaggagtttacggtcgatatcccgtacaacttcggctaatcatgttatctaaataagttggggtttgcagttgtcagggcgaaatcagattcgactatacagcccagttcagagccctaactcacgtaatcgtgaccttacagagcgagtcaagttaattacctatcgagtagctcaatatgagagagtgtgaataagaaatttattgcaaggcaataatcctaattattgatagcaaactttgataagaataaagaatagcacaattcagaaagcgtacttactgtcatactcgaatgaaatgctttattaaagaaaaagttgacgtcctatgagaagattaagaacttctcctgcatctcacaacctacttaatcttcggggatgggtaatagataggtgaacatataaatagagataagtttctaccttcaaacgtagttaaacaagtcatagctatatcccacaaacctttcataatcactgtatcgggatatctaagaagtaatggtatggctagtgatcaatcataatttgtcagttaagacaagatgcggtaaattgtgtattgcgagtcctattgtctcgacttaaactgtctgatgttataacaaatacacagtagttaattgtcaattgcttatgtactgctacgccttgtggagaccggtccggcgcgtgaaggatataaatgaaactcgtcacatccacattattatatcgtacatcggagtacgaatcgaacttggcctctatttttagatgcgtgcgctgcaagtgtaaatgtaccaaatctaaaaattacgatgggttttgtttcaggtatccaaaaagtaattctgatgccgcgcttcaattcactaaagtgaggatgttgtctttatacgggtttgatacttttattgtaccaagcatctttattagttagcactatccccaacgtataacagtttactttctcggtgtgagcccctcgtcaactgcctgcagtagtgcacgttgaagccgattagaatattagattttttcaactccaaacgtcaacagtcccgctctagtttaagttcatatatcaggacaggtctcggaattaagtgtataagcgctgggaactttcgcgcagttcgaatagtgagtaagtgatcgagttacacaccgttagattcatccttcagataacgttccgtttttttgatttataactatcgtttgaatcaattccatcttcttaacgtgttaagtcatccgcaaaaaagacgatatgagcttaccttacgaaataatttcatttcgaactacagggtgctctacttgctcttgaagatatcgtagagtgttggatgaattaaaaccccctacccattttcaatcgacttgtatgtttatccttaaactaacatggaaatttgctttgatttgtttagtatcatttaggcgtgtttcaaatgtataattaagtatgccgcatagtttctccattaccgaactgaacaccacttagtgtcaaacactcattgctgttctacgccatttatgacattacgctcaaattaactgagctgaatttcaaagactataatattatttttgtgttaccaattaacagttaacgaatacgtgacgatgtagaacaccaggagccaggtcggacgcatcctatatttacttcgtgcagagtaggtctaacaagatagcatggaggtttatgcttaagttgaaccgcagataaaggtctatactcgggatcttcactatctgaaggtttagaattttaatggtaccctatacaaagtgcataggtttttcattaatattaagacgcaaaggtaagtgaattcactcctacaacggaaatatgaccaaagtatcaaaacaatatggttcgtagaaaaaatcgatcgtgataaaggttggattttgacaaaacaaagagctacagtctgggaacagtcgatggacgccaccacgtgctttttcggctaatcttataatttataaatgttgaggtttagaattctcgggacgagatcaaatttaagtatatagtcatatccgaagcgttaaatcacttattcgccatgcttaaaagcgcctcatgcttttcactgattcattagctctatgtatggcaatctatgtacgaagtctgtcgtaagacttaaaaactaaatattggtagcttccttagttaaagtacaaggattgcacaattcagtagacattttttctggtattcccgaacggaaagctttattaagacaaagtttgatatccgacgggatgaaccacaagttctatgatatctcagaagctactaaatttcgggggttgggtacaagttagttgaacatacaaattggaatttgattgtatccttggtcgattctaaacaaatcgtagtaaacccgtgcaaagtatatatattatttcatacggcgtttcaaagaggcaatggcttgacatgagctggatttcagattatgagtaaccacaagatagtgtaaacactgtaatccatatttaattgagatctcttaaaaatgctgatattattttctaaactcgatggtttattgacaattatttgtacagtgatacatctagcggttcttggtcgaccctacttacgtaataaatgtagcacgtttgatccagactcatccatggtagcttcaaatacggattcaacttggcgtttatatccagaaaacggccctagaggtgatagacatttaacactttggacaaccattggatatgtttcacgtatcgatatagtaattattattctgcatttgctttctagtaagtgaggaagaagcctttctattggtttcttaatcctcttataccacgcgtgtatctttcctagccctttattgaaactggaagtgtcttgttattcaatgttaaacccttgtcagcctattgcggtgatgcacgaaaaaaccaaatggaatataaaatattaactactcctaattttaagtgccctcttctagattgtattcatatatcaatatagacttcgcaaactagtgaatgagggaaatgaatttatccggaataacaaaagggactgagtattcaagatacaaaccgttagatagatgttccagtctgcatagtaaatttttgttttttaaccattgaaggaatcaatttcacgatccttacgagtttagtcatcagaaaaagagacctttagcgctccccccttgaaatagtacagcttcaaacaataacctgagtaagttggtatccgaggtactataaatttttcgatcatttgatgcccccatcctatgtttaaagaactattatctttagccttaagcttacacaggaaccagctgagtctaggttaggttcacttgggttgcttacatatataaaataatgtataccgcagaatttgtcccttagggaattgtagttgaccaaaagtctattactcattggcgttgtatcacttttgtgtcaataggtatgatcaatctcttggaaattattacgatgttggtaaaagattagaactactaaacaactgttaataatcaagtcgctccgtagattgccaagaatcagttgagatgaatacgttatttagaacgtacaaactacgattgagttggtaccatcgtagtttatgcctatgttaatccccaattatacgtcttttgcccgaatccccactatctgtgaaatgtttaacgtgttcgttacctttacaaaatacatagctatatcatacgtaaaaatatcttaacggaagatcgtacactctttcttcggatagataagcaaagaaataggaggatatggtgcacacatggaaagggccggtaagtaattctggccttcatagaacaatatgttataatttggaaattgtcggatagcgcgactatgtgcttaattggtttactttaaattttataattgatgacaataaaaattcaccggagaagttctaacgtaagtatatagttataactgaacgattccaagatttactcccttaagttaattagacctatttgttttccctgactcctaagttttatggttggcaatttatctgcaaggagacacatatcatttagaaataaaaaattggaaacttctttagctgttgtgctgggaacgctcatatcaatacttttcttctctagaagttgaaaggggggaatattatcatgtcgaagtttgttataagagtcattctaccatacacaccatgattctgaaagtgctggtaaactacgggaataagatacatatttctcattattagaattcagacctcaaatgagtcgttggtcaactcagatccgaatcgaaagaacccaacgaatatataacttttattacatgtgttgtcttagtcagagtattccttaacattaactggttttcagacgatatgtaactgcagcagagtcaaatcatggatattgatagtagttagagaaccattgataatgttacaaccattttctaattttgatgttgtgtagacaattattagttgagcgagctaactaacagttcttacaaatctctactcatacaataaattccgtgagctcaacactaactcaacctaggtaacatcaaatgccgatatattcaggggttattatgcgagatatgcgcttagggataatagacactttacaaattgcgcatgcgatcgagatattttatgaatcgatataatatgcattcttatagaattgcctgttagcgtaacataaataaacgtatctaattacttttttatccacgcttattacatccgtaccatttccggccattcattaagatcggaagtaccttgcaatacaaaattaaactttaaataccctatcacgcagatttagcaattattttaatcaactttagtggatcaatcatagacatttttaagtggtattttcaaggtggcatttaaatattaatgatgacatattaaggttttaaatgagagaattcaattaatttggttagacaaagggatccgaagatattttatcgcaaccattaaaagggcgtacctctgtctacaataagcctttatttttaaatgtttgaagaaatcgtgaagacgactgttgtcaatacaaatatgataagaacagtactacatctttgctccgcaataatagtacagcttcaagtaatattcacagtaaaatggtatgtctggtactaagactttcatgactgttcgacgtttatactttaagtataaagagtagtgatccgatgtctggagattattctacatccaattgactctaagcacagccttcttggcttgctagtacattgaaagtgatatactcaactggacgagactcgaaaggaaatatgattgaccataagaccgctttgtttcgacatcgtcttagtacagtactcataattatcatcattcttttagtgcctattacaatgttggcaaaagaataaatctccatcacacttcttgaaaatgtacttggtcgtttgattgttgagaaagtttaatgatgagtatgttatttaaggcactggtgtactgatagagttggactaaatgttaattacgagtatataactcttcaataattcgctctatacgcaaattcctattatctgtgaaatgtttaacgcctatggtaactctgtaaaatatttatctacgttataccttagaatatcttaacggactatcgcaatatatctacttgtactgattaatgggaaagtaggtgcgataatcgaaggtatggtaaacgccggtaagtaattctaggcaacaaggaatgttatttttttaattattttttaaggcattgtacgtctaaatcatcaataaaatttgttgaaatcaccttgtttgattttgtaaaaatttgtcttaaaactatcaccgttaattaaagattactacactataattccagaatttacattcttaagctatttaaactaatctgtttccctaggcttctataaaatcgcgtcagtgattatcccccttggagacggatgtttttcgcaaataacaattaacaaatttctatgtcacttctgctgtcagcaattttgtttttactatacttgttatgatgtagattcgtcgcgttattgcgttgtcgaacttcataaaaagtgtctttttaccatgcagatcaagattgtgaaagtatagacaagcagcaaatacgaaaatacaactacagttttagcggtaaagtctatctaaatttaataatgtcagtgttatgtgactactttttatatttcttcgcaacctttattatcgttgttttaaaccaaattgccacttacttctaaacgtcaatcagcctcttggattacaacaatttagtcgataacttcgtcgatctcttaggatttttcatgttaatgctctgatacatttttgtagcctgatattttgtctgtttctgccataacaactcgatccgacaggtgaggtattagcaggaatatcatcatgtcagcgtaattaaattatgcaccagtcgtaaaatcacggtttattagcagtttaacatgcgtatagtctaaccctacatacacgatacctgaaaatcgtaatgatcttagtaagggattgttaaaacggtattccgaggcggtgcattaatttgctatggtatggttattcttattacacggtttagaaacaattatagtggctaagaatgcaactagttattacgaacggccacgaatagtagaaaatttccttcctgcgggcttctcctgaaatgccatttatacgggttattgaagccggttactacgacagatttattcaacctcaaaggtctatattcccagcttattcttagccgatatgttgcgtcgtgtcccagctttgaatgcgttaacaccggattgtctgacttagttcagcttttggatacctcatcgggttatactaactgacacttattctttaaataaggatcccttattgggagtggtaagtgagatttgggattatccttatttctaatgatcttacccctttcgcatgaataacagtacgagcttattttacgaggatatcacttgatcaagtggaggatactcttccaattcttgaataggacctagagagttgaatgtattagatggacgtacgcattatgtgctcagttgtataattgtgtgttttcaaggaaggaagtatgcgtcaattcgttcagtatcgacataaggtatttggaaagttttagtgacatagaccaatagattttagatctctttacccatcagtaaataccattatagagtcaattcaaatttacgctatttaacacacaacgccgaggataaaagggctgaaattgacagtctactattttgttcatgtgtgaacaattaacaatattcgaatacacgttgatgcgatagtgctctggctaggctgtccacttcgtatattttctttgagtagtgcagacgtattaatataatatgtagccaggatcttagcatgaaacgatgattaaaatgtacgcataccacgttgggatgtatgtgctatagacttttagtattacctgaaacatagtccatcgattttgccataagacttcggcacgaaattaagtgatttcacacctacaagagaaatgtgccgaatctatgataatatcaccgttcgttgtattaatcaataatggtagcggctgcatattatcaaatgaaggagcgacacccggggaggagtttacggtggatatcccgtacaacttcggctaatcatgttatctaaataagttggggtttgcagttatgagggcgaaatcagattcgactatacagcgcagttcagagccctaactcacgtaatcgtgaccttacagagcgagtcaagttgataacctatcgagtagctcaatatgagtgagtgtgaataagaaatttattgcaaggcaataatcctaatcattgacagcaaactttgataagaataaagattagtacaattcagaaagcgtacttactgtcatactcgaatgaaatgctttattaaagaaaaagttgacgtcctatgagaagattaagaacttctcctgcatctcacaacttacataatcttcgggcatgggtaatagataggtgaacatataaatacagaaaagtttctaccttcatacgtagttaagcaagtcatagctatatcccataaacctttcataatcactgtatcgggttatctaagaactaatggtatggctagtcatttatggtaatttgtcagttaagtcaagatgcggtaaattgtgtattgcggctcctattatcccgacttaaactgtctgatgttataacaaatacacagtagttaattgttatttgcttatgtactgctacgctttgtggagaccggtccggcgcgtgaagcatataaatgaaactcatcacatccacataattatatcgtacatcggtgtaggaatcgaacttggcttctaattttacatgcgtgcgctgcaagtgtaaatataccaaatctaaaaatcacgatgggctttgtttcaggtatctaaaaggaaattctgatgccgcgcttcaattcactaaagtgtggatgttctctttatacgggtttgatacttttattgtagcaagcatctttattagttaatactatccccaacgtataatagtttacttcctcggtgtgggcccctcgtcaagtgcctgctatagagcatgttgaagccgattagtataatagattttttcaactccaaacgtcaacagtcccgctttagtttaagttcatatatcgggacaagtctcggaattaagtgcataagcgctgggatctttcgcgcagttcgaataatgagtaactgatcgagttacacaccgtcagacttattcttcagataacgttccgttattacgattaataactatcgtttgaaactattccatcttcttaacgtgttaagtctttcgcaaaaaagacggtatgagcttaccttacgaaataatttcttttcgaactacagggtgctctacttgctcttgaagaaatcgtagagtgttggatgaattaaaagcccctacccattttctatcgacttgtatgtttatccttattctaacatggaagtttgcattgatttgtttagtatcaattaggcgtgtttcaaatgtattaataagaatgccgtatagattctccattaccgaactgaacactacttagtattaaacagtcattgctgttctacgccatttaagacattacgctcaaaataactgagctgaatttcagagactataatattatttatgtgtcaccaattaacagttaacgaatacgtgacgatgtggaacaccaggagccaggtcggacgcatcctatatttactttgtgcagagtaggtctaacaaaatagcatgtaggtttatgcttaagttgaaccgcagataaaggtctatactcgggatcttcactatctgaaggtttagatttttaatggtaccctaaacaaagtgcataggtttttcattaaaattatggcgcaaagctaagtgaattcactcctacaacagaaatatgaccaaagtatcaaaacaacatggttcgtagaaaaaatcaatcgtgataaaggttggattttgacaaaacaaagagccacactctgggagcagtcgacggacgtcaccacgtgcattttcggctaatcttataatctataaatgttgaggtttacagttctcggggcgagatcaaatttaagtatatagtcgtatccgaagcgttaaatcacttattcgccatgcttgaaagcgcctcatgcttttcactgattcattagctctatgtatggcaatctaagtacgaagtctgtcgtaaggcttaaaaactaaatattggtagctaccttagttaaggtacaaggattgcacaattcagtaggcgttttttctgctattctcgaacggaaagctttattaagacaaagcttgatatcccacgggatgaaccagaagttctatgatatctcagaagctactaaatttcgggggttgggtacaagttagttgaacatacaaataggaatttgattgtatccttagtcgattctaaacaaatcatagtaaacccgtgcaaagtatacatattaattcatacggcgtttcaaagaggcaatggcttgacttgagctgaattacagattatgagtaaccacaagatagagtaaacactgtaatccatgtttaattgagaccacttaaagatgctgatattattttcaaaacacaatggtttattgacaattatttatacactgatacatcttgcggttcttggtcgaccctacttacgatataaatgaagcacgtttcatccagattcatctatcgtagctccaaatacgaattcaacttggcgtttatatccagaaaagagccctagaggtgatagacttttaagtctttggactaccatgggatatgtttcacgtatcgaaatagtaattattattctgcgtttgctttcatataagtgaggatgaagcctttatattggtttcttaatcttcttataccacgcgtgtatctttcctagccctttattgaatctggaagtgtcttgttactcaatgtcaaacccttgtcagcctcttgcggtgatgcacgaaaaaaccgaatggaatataaaatattaactactcctaattttaagtgccctcttctagattgaattcatatatcaatatagacttcgcaaactagtgaatgaggggtatgaatttatccggaataacaaaagggactaagtattcgagatacaaaccgttagatagatgctccagtctgcatagtgaatttttgatttttaaccattgaaggaatcaatttcacgatccttacgagttaagtcatcagaaaaagagaccattagcgctccccctttgaaatagtacagtttcaaacaatagcctgagtaagttggtattcgagatactataaacttttcgatcatttgatgcccccaacctatgtttaaagaactattatctttagccttaaactaacacaggaaccagctaagtcttgtttagcttcacttgggctggttacatatataaaataatgtatgccgcagaatttgtcccttagcgaattgtagttgaccaaaagtctattactcattggcgttgtatcacttttgtgtcaataggtatgattaatctcttgaaaatttttacgacaatggtaaaagattagaactactaaacaactgttaataatcatgtcgctccgtagattgccaagaatcagttgggatgaatacgttatttacaacgtacaaactacgactgagttggtaccatcgtagtttatgcctatgttgaaccgcaattatacgtcttttgcccggatccccactatctgtgaaatgtcaaacctgttcgttacctttacaaaatacatagctatatcatacgtaaaaatatgttaacgaaagatcgttcactctttcttcggaaagataaccaaagaattaggaggatatggtgcgcacatagaaagggccggtaagtaactctggccttcatagaacaatatgttataatttggaaattgtcggatagcgcgactatgtgcttaattggtttaccttaaattttataattgatgacaataaaaattcaccggagaagttctaacgtaagtatatagttataactgaaccattcgaagacttactcccttaacttaattagacctatttgttttccctgactcctaagttctatggttggcaatttatctacaaggagacacgtatcatttaaaaacaaaaaattggaaacttccttagctgttgtgctgggaacgctcaaatcagtactcttcttctctagaagttgcaaggggggaattttatcatgtcgaagtttgttataggagtcattcaaccataggctccatgatactaaaagtgctggtaaactacgggagtaagatacatatttctcgataatagaattcagaattcgaatgagtccttggtcgactcagatccgaatcgagagaacccaacgaatatataatttttattacatatgttgtcttagacagagtattccttaacatcaactggttttcagataataagtaactgcaacagagtcaaatcatagatattgatagtagttagagaaccattgataatgttacaaccattttctaattttgatgttttgtagacaattattagttcagcgagctatctaacagttcttacatatctctactcatgcaataaattctgcaagttcgacactaactcaacctaggtaacatcaaatacggatacattcaggggttattatgcaaaaaatgggcttagggataatagacactttacaaattgcgcatgcaatcgagatattttatgtatcgatataatatgcatttttatagaattgcctcctagcgtaacataaacaaacctatctatttgcttttttatccacgcatattacgtccgtaccatttccggccattcattaagatcggaagtaccttgttatacaaaattaaacctttaataccctatcgcgcagatttaggaattaatttaatcaactttagtggatcaattatagacatttttaagtggtttcttcaaggtagcatttaaatatcaatgatgacttactaaggttctaaatgagagaattcaattaatctggttagacaaagggatccgaagatattttatgccaaccattaaaagggcgttcctctgtctacaataagcctttatttttaaatctttgaagaaatcgagaacacgactgttgtcaatacaaatatgataagaagagaacttcatctttgccccccaataatagtacagcttcaaataatattcacagtaaaatggtatgtctggtactaagactttcatgactgttcgacgttcttattttatgtataaagagtagtgatcccatgtctggagattattctacatccaattgactctaagcacagccttcttgggttgcttgtatattgaaaatgatatactcaactggacgagactcataaggaattatgattgaccataagaccgctatgtatcgacgtcgtcttagtttagtactcataattatcatcattcttttagtgcctattacaatgttggtaaaagaataaaactgcatcacacttcttgataatgaacttgctcgattgattgttgagaaagtttagtgatgagtatgttatttaaggcactcgtgttctgatagagttggatccattgttaattacgagtatataactcttcaataattcgctctatacgcaaattcctattatctgtgaaatgtttaacgcgtacggtaactctataaaatatttatctacgttataccttagaatatcttaacggacaatcgcaatatatctacttgtactgattaatgggaaagtaggtgcgaatattgaaggtatggtaaacgccggtaagtaattctaggcaacaaggaatgttatttttttaattatattttaagggattgtacgtctaaatcattaataaaatttgttgaaatcaccttgtttgaatttgtaaaaattcgtcttaaaactttcaccgttaattaatgattactacagtataattccagaatttacattcttaagctaattaaactaatctgtttccctaggcttctataaaatcgcgtcagtgattatcccccatggagacggatgtttttcgcaaataataatttacaaatttctatgtcacttctgctgtcaacagttttgtttatactattcttgttatgatgtagattcgtcgcgttattatcatgtcgaacttcataaaaagtgtctttttaccatgcagatcaagattctgaaagtacagacaagcagcaaatacgaaattcatatttttgatcacaaggccacagacctctagtaagatgtacgttaactgaggttcgtgtcggtagtaccaaacgttcatgtaactctcacaatgcgaattgacctgctttgagctcttctatatactaactggtattctggcgaaacaaagctgtggtagtattatgtcatgagtattaatagtagtaagaaaatcagggataatgtttcaacggtttacttatttagaggtagtgtgaggtacttttacgtgaactagcaaactaacatctcttttaaattattactcttacaataagttccgtgacgacatgattatctcaacctgatatacaattgatgttcttatattgaaaagttattaagcgagatatgtatttaagcatagtagacacatcacaagttgcggatatcattaagacaatttataaatagttccattgtggaatcttataatataacctgatagcgttatattggtgaagatggctaattaccctctcaccggcgctattagcttccataccaattggcgccattcattaagatccgttgttccttacgaaaaaaaaatttataagaaatcctgtaacatgcggatttagtagtttttattaacaacattactggagcaaactaaaacatttaaagacagaattttggcagaggcaattaatatcatatgatgtgaaattagggtctatattgtaataatttgataaattaaattagataaggggtttggaagataatttagcacagttagttataggcggaagatttgccttcaaaaagcgattattgttatttgtcttaagttacagcgaaaacagcagtcgttaaaacaaaaatgatatgtccaatattacatctaagcaaggcaatttcgcaacaggttaaggtattttttatagaaaaattaaaggtccagttcaaacactttcatttgtgtagctcgtttatgcatatggtatgtaaactagtgcgtcggtgtatggagatcttccttcttgcgtatgattgcatggactgcgatcacgttttgtaagttcattgagactgttacgcttaactgctcgaaattcgagaaaatatacgactgttcgtaagagcgctttgatcgaacacgatcataacagagcacacatgataatcatcacttttttagtccctattacaaagcagccaagtgaatatatgtctatcactcactatgaatttgcatatgatcgttttattgtagaaataatttaataaatagaatgttaatgaagggtctactgtacttatacaattgggctacatgttaactacaagactatatcctattattgacttagtgtatacataatatggtttcatatatgtagtgttcaagggctatagcaaatctgatgataaatgattagggtaacaccttagaataatatactagcctatcggaacacaagcacttctgccgtataatccgagtgtggccacgataatggaaggtatggtcgaccgttgttgctaatagtaggcgataacctatccttttttcataaattttctttagaacattgttcacataatatatcaggattaattgatgtaatgagctcgcttgattttgaaaacttgtgtttttaattcgtctccgattaatacactatactaaattttaaagccagatatatcaatattaaactatttaatttaacctaatcctcaaacgttctattaaaccgtgtcaatcaatatctgcttcctaaatgaaactttttcgccaaaatcaatagttagaatctaaagtcgctttcgtccttagctatattgatttctttatacaggtagtaacgtagattcattccgtaaaacggtttttcatttggatataaaacatttctttgatctccaggagaaatatgagaaactaaacacgtcgagtaaatacgtatactgctcatttgtccacgcacccacatacctctggaaggaaaaacacatactaacctacctgacgctagtgtaaaatatccaagagaccctgacagtgcgatttaacgagcctttaactctttcattagctgataagcattattgcgaaactagcttgagcttgtattgtccagtgtgtagtattagaagtgaaaaaatcagggttaataactcgtggcgtcatttacatactgttagccagtgacaggtaaacgtatactagcataacgatatcttaattaaattatttatcttacacattcttcctagatgacatgaatatgctggtgcgatgtataattgaacttctgatataggataagaactggaacacatatgtattatactaatgcatgtacatcctaagttttcaatatcgtttagagtacaatttacaaatccctttccggaatcataatataagatcggatagccttgtgttcgtggaaagggcacattagggtcacagtggtggtattacttatcaaactagctagcaataacgataatcatgtactactgaacaggaaaattgtatttaaaagaagacttataactaatgttttacatagtcctaattgattacattactcgggggaactaaaacccatgaccactaaaataaagctgagtctaattatgtgatttgatttaaaatttcgatctatataattataatttcgagagataaattggattagctatttgctagatgatttggcacagaatgacacagacgaagaacttactatgaaatagcggtttcagttgtcaatgatggatttcagcgaaactaggaaacgatgtagcttaagaaatatctctctcattgcatttagataaagcatcttgctaaaaagagaaccagtactttgtaaagtaactagaggttctctttatactctgtgatttgtccagttcttaaaagcaaacgaggagtaatcaggtgcgtgggtaaaagcagaccttcatttttaagtatgattagatggactacgattacattttatgggatctctgcgactgtcacgctaaaacactcggaaaatgacaatccaatccacaactagttataacccactgatcgaaatggagcataacgggtcacacatcataaatttcactattttagtccgaatttttcagcattgcggtagatgtgtaacaaccgaccactgaccatctacatattattatattccataagatttaacttaatatatagaaaacgcaagtaggatctactgtacttatatcaccatgctacatattaagatgtaagctaaatccaattcttgtccttgagcatatatatcaaaaatacgaacattttggattcaaaagttatagcaaatcccaccctaaacgtttggggaatggttttagtattatattctagcctattagaacagaagcaccattcccatgtaaacccagcgtcttcatcacattgaatactttcatcgattaatattgtttttaatatatgatgactcgaccttctaacataaattttctactgattatttataacaatatgtaccaggattaaccaaggtactgagcgcccatggttttgggtactggtgattttatttcgactcaaatttgcgcactaaagtaaattttaaagttagacatacagatattataggtctctatatgacgtaaacgataatcaaatagctaaaccgtatgttactgagtctgcttcttgagtgatactttagccccttagtctacggttactagcaaaactagttttgttctttcgatacaccgaattgtttatgaagagagtaacataaatctattttgtagaacgactttattctaggtcatgaaacatttcgttcatctctaagaatattacaagacatcaagtagcccaagatttttcgtttgctcctgattaatccacgcacccattttcggatcgatgtaaaaattcattttagtctatttgatactattcaaatataccctaggcacgcagtcagacgcattatgagactcttttactgttaggttaggtgttgttcgatactgggtgtctgccaatacctcatattgcccacagtgtcgaatttaaatcggtcaaattaggtcctcaaagttgtaacgccatctccacattgttgggtggtgaccggtaggtgtataataatataaggtattgaaaattgaattaaatatactttgcgcccgttctacatgaaataaattcagtcgaacgatgcaagaatctacattcgaaccaagttatgagcgcgaactcctatttaaagtttttatcgttcaaaaacctgagagtttaacaacgttttacgtgggacatgcaaaccccttaccaatgtcgaaatataggaatgaacaaatctgtcttcgtgctaagggtacaattaggacgctgaagtaatgtaacttatatgcaaggcaaattataacaaaaattaaattccagtaaggtggaagattgtgatttaaagatgactaataaatattgttatacatcctcctaatcggttctacggtttacgagcaccaaaatccaagacctctaaaataaagctaagtttagacgcgtgattatacttaagatatcaaactgttcgtctattatatccagagatattctgtatctcttattaatttatcgatctcgtatacaatgactcatttatagaactcagtatagaatctaaggatcgggtgccaatgatccttccgatcagaacatgaaagctatgtggtctgacgattacttctctcaatgtctttagaaaaaaaatcccgctgcaataggatccagtacttagtaaagcaggttgtgaatcttataatgttttgaagatcattggattttaaaaaccaaacgtggactgattagaaacgtaagctaaaatctagccacatttctaactagtttcagataaattataataggtttatatggtatgcgtaccccattctgcataatactttaagagaaagacaatccaatgttgatcaagctttgaattacaaacgattatgatgtaataggggtgttatggcttatattaagccagaaatttttaggagtatcaacattgcccttcggctctaataactcactagtggtcatcgacatgataatatattcgataatttttaactaattttatttgtatggcgggcataatatatttagtttgagtctgcttgcaacgatgttagacataagcttggttcaatactcgcgcttaaagaataatttcaaaaacagcgagtgtttggtgtcccaaatagttactaaatgcaccctgtacgctagcataacggttactactttatatccattcttcaatagacagaaagaagattctctcgttaattttccaacttctttacattgtatatacgttccctttaatttcctattagaattaaggacattccatcatctaacactaaatttctactgatttattataacaacatgtaggtggattaggcaagacccgaaatgctggttgtctttggttctggatattttttctcgaactatatctgcgcgttaatatgaattctatagatctacaagcagaaaagataagtcggtttaagacaatgggaaaagttagatacctagagtattaattattgagtaaatatcttctcatatatgatagattcctaccccccggttgctaggaaggttagtcttgtagtttccatagacctgactgctaaagaagagagtttctgatatcttttttttagggcgacgtaatcctagatggtgattcaaatggaccaacatttagaacattacaattcttctagttacctagtatttttattttgcacctgggaaatcattgcttttgattctagatctgtgtaaagattgatcagacttgaattaaatttgtccaaattatccatgtgcatgagacaacatatattatgaaattcacttttcaaaaggtcacaactagttggagacttattgtttgctaatattacattatcctcacattagcgattgtagttggctctctaaaaatcgtcatagtaccaatggggagccgagattattgagtgattaccagtagctaaactatttaataagctattaaagattgatcaaagtaaacataccgcctgaaatatataaatcatagtcagaccaacattgctacaattcgtattcgcaccaacttttgaccgcgtatttcccatttaagcttttgttgctcacaaaacacttggtatacctatcaatctcatgggacatgcgatcgtactgtgtacgaaggtatttcggtaagaagttatgtcacttttatctaagtaagcaaataaaaagataaaaaaatgcaatatatatgcaagggaaattaatggacgatcttaattcctgtaaggtaacacattgtgactcaaaaatcattaaataatataattgtacatctggctaatccgttctgggcttttcaaccaacagtaacggagacttattaaaaagattttgatacggacgcgcaactattgttaggtaactttgaagtccgtcttttcgaatcagccaaattcacttacctttttgaatcttcggatgtcataattaatagctcgtttatagaagagtatacactatctaagggtggagggccaagaatccttccaattactacattaaagatatctgcactgacgttttctcttctcaaggacaaaagtaaaaaaatgccattgcactaggatttaccgcaaagattacctcgttgtatatattgcagtcttaagaacatcaatggatcataaaaataaaacatgcatcctttactattaaaatctaagttctagacaaattaccaattagtctgaacttacattaaagagatttaataggtacacgatctctgtcgtataaattactttaactgaaatgttttccagtattaatcaatccctgaatagcatacaattataatgagactagactataaacgttagcaacgacagagagattattagcagcatcatagttacctctccgctctagtatcacacaaatggtcgtcgatcagatagattggtcgataatctccatgaactatcgtctgtatggcggactttataaatttagtatcagtctggtttaaatgatgttgagcattagtgtgcttaaaaaccgtcacataaagcgtatattcgaaaacaacgagtgtcttgtgaaccatatgcataattagagtactctgtagactagtatgacacatggctccacaaagctatttatcgatacaataaccattagatactgtgggctttgacgttgctaaccagccaaccatctatgtttttgaaataaagaactcatatctttctttaatgttctacaaatatgtctacatccttttttctaggtcatgaaacatttcgttcatctctaagaatattacgagacatcaaacaggtcaagatttttcgtttgctcctgattagtccacgcacccattttcgcttcgatgtaaaaattcattttagtctatttgatactaatcaaatataccctaggcacgcagtcagaggcattatgtgactcttttactgttaggttaggtgttgttcgatactgggtgtctgccattacctcgtattgcccacagtgtcgtatttaaaacggtcaaattaggctctgaaagttgtaacgccatctgcacattgttggctggtgaccggtagatgtataataatataaggtattgaaaattgaattaaatatactttgcgcccgtcctacatgaaataaatttagtggaacgatgcaaaaatctacattcgaaccaagttatgaacaggaactcgtatttaaagtttttatcgttcaaaaacctaagtcttcaataacgttttgcgtgggacatgcaaaccccttaccaatatcgtaatataggaatggacaaacttgtcttcgtggtaagggtacaattgggacgctgaagtaatgtaacttatgaggaaggctaattataacaaaaattaaattctagtgaggtggaagattgtgttttaaagatgactaataaatattgttatacatgctcctaatcggttctacggcttgcgggcaccaaaatccaagacctctaaaataaagctgagtttagacgcgtgattacacttaagatatcaaactgttcgtctattatatccagagatattctgtatctcctattaatttatcgatttcgcatacaatgactcagacatagaactcactatagaatctgaggatcaggtgccaatgatccttccgatcaaaacatgaaagctatgtggtctgacgaatacttctctcattgtttttagataaaaaatctcgctgaaataggatccagtacttagtaaagcaagttgagaatcttataatgttttgaagatcattggattttaaaaaccaaacgtggactaattagatgcgtgagcaaaaatctagctacatttctaactagtttcagataaattatgataagtttatatggaatgcgtacgccattctgcataatactttgagagaatgacaatccaatgtagatcaagctttgaattacaaacgattatgaagtaatacgggtgttacggcttatatttagccagaattttttaggagtatcaacattgcccttggggtgtaataactcaccagtggccatccacatgataatatattccataacttttaactaattttatttgtaaggcgggcaaaatatattttgtttgagtctgcttgctacgatcttagacataagcttggttcaatactcgcgcttaaagaataatttcaaaaacagcgagtatttggtgtcccaaatagttacaaaatgcaccctgtacgctagcacaacggttactactttatatccattcttgaatagacagaaacaggattccctcgttaattttccaacttctttacattgtatatacgttccctttaatttcctattagaattaaggacattccatcatctaacactaaatttctactgattttttataacaacatgtaggaggattaggcaagatgcgaaatgctggttgtctttggttctggatattttttctcgaattaaatctgcgcgttaatatgaattctatagattgacaagcagaaaagataggtctgtttaagacaatgggaaaagttagatacctagagtataaattattgagtaaatatcttgactcatatgatagattcctagcccccggttgctaggaaggttagtcttgtagtttccatagaccagactgctaaagaagagagtttctgatatcttttttttagggcgacgtaatcctagatggtgattcaaatggaccaacatttagaacattacaaatcttctagttacctaatatttttattttgcacctgggaaatcattgctttcgattttagatctgtgtaaagattgatcaaactcgaattaaatttatccaaattatccatgtgcatgggataacatgtattatgaaattcacttttcgataggttacaactagttggagacttattgtttgctaatactacattatcctcacattagcgaatgtagttggctctctaaaaatcgtcatagtagtaatgggaagccgagattattgagtgatcaccagtagctgtactattttataagctattaaaaattgattaaaataaacataccgcctgtaatatataaatcatagtcagaccaacattgctacaatctgtattcgcaccaacttatgaccgcgtatttcccatttaagcttttgtcgctcacaaaacactaggtttacctatcattctcatgggacatgcgatcgtactgcgtacgaagatatatcggtaagaagttatctgtcttttttctaagtgagcaaataaaaggataaaaaaatgcaatatatatgcaagggaaattaatggacgatcttaattcctgtaaggtaacacattgtgactcaaaaatcactaaataatatagttgtacatctggctaatccgttctgggctttacaaccaacagtaacgaagacttattaaaaagatcttgatacggacgcgcaactatagttaggttactttgaagtccgtcttttcaattcagccaaattcacttacctttttcaatctttggatctcataattaatagctcgtttatagaagagtatatactatctaagggtggagggccaagaatccttccaattactacattaaagatatctggactgacgttttctcttctcaaggactaaagaaaaaaaatcccattgcattaggatttaccacaaagattacctggttgtatatattgcagtcttaagaacatcaatggatcataaaaataaaacgtgcatcctttagtaataaaatctaagttctagacaaattaccaattagtctgaacttagattaaagaggtttaataggtacacgatctctgtcgtatatattactttaactgaaatgttttccagtattaatcaatccctgaataacatacgattataatgaaactagactataaacgttaacaacgaccgagagattattagcagcatcatagttacctctcggctctagtatcacacaaatggtcgtcgattagatagattgctcgataatttccatgtactttcatttgtatggcggactttataaatttagtatcagtctggtttaaacgatgttgagcataagtgtgcttaaaaactgtcacataaagggtaaattcgaaaacaacgagtgtcttgtgaaccatatgcataattagagtactctgtaggctagcatgacacatgcctccacaaagctatttatcgatacaatataaatagatatattcgcctatttttctgtttatatccgttatatttacgttgtctttaattacctgccagaattaaagacattccatagtgtaggactgggttttcagtatttcattatataaacttgatgaccagtttggctagtcccgacaagttggttgtgaatgccctcgaataattcttctaaaacaatgcctgggtgttgacagcaatccattgaaacttcaggcagaaaagcctagccggtttaactgagtggaaaaacttagaagcgttctataatgattatcgaggaaatatattctcatttgtgacagatttccacctccggattcttagaaaggttataggagtaattactattgacgtgagtgcagtggagaagaaatcatgttttcattttatgacggtaacgtgatcctgaatggcgtttataatggagtaatatatttaacgtcggaattcttgtagttatctagtatttatattttgaatataggagataataattttacattcaagaattgtttcatgcttaatcagtcttgaatgtaatttctctaaatcatccatgtgccaaagacagcatatttaatcaaataaagtttagaaaaggtcataattagttacggagttatcctatgttaatattactctgatctgatatttgcaatcgctgctgtctctccaacattcgccgtaatatcaatagagaggcaagatcttactatgttttccaagggcaagtctaactatccagtcattagagggactcgatagcagacgtactgcctgaaatatttacatgttagtgagattaaatttactaccagtcgtaaacacacgattttttagcagtttatttcgcatataagcttttgttgcttacaggacacttggtattcgtaatgatctcatgaggcgtctgttcatactgtattccgaggcgctccgataaatagctatgatatacttatctatattagtcgataaaaagacaaatatagcgattaaaaatgcaacaaatattaatgaacggtctcaaatagtgaaagatatcgctccttcggccatctctcaaaaagccatatattcgaattactgatgaagcccatcagggctgttctatctagtcttataggagtttattttgaggttattgttaccgaccgacaaccgtcgtgtcgtaactttgaagtccgtgtttccggatcgtctgaattggttcacctttttgaatcttcgtaggattatactaatagttgctttttgtaaaagtaaacactccctataggtagtggtctatgagtttttgcattatccttattattgataattctactcatgtcacgtctactatagtacaaatttattataccaccatagcactagatcttatggagaatactctctcattacataaattggagccacagggacatgaatagatgataaatatagagattatgtcctcaattgtaaaattgtgagttcttaacaaagtaggtattagtcagaacttacattaatgacattaggtatttgcacagtttcagtgatatagattagttcatttcaaatctttttacgtattagttaatgcctcaatagagtagaattataataacactatattataaacgttagcgacgacagagaggttgaaagcggcattctagtaatctgtccgttcgagaacaatataaaatgttcctgtacagattgataggttagtattctccctaagctgtcctctccataacggactttatagtagtacaatcgctttaatttaatacatggtcagcatttttgtgccaaaaaatcgtcaaattaaacgcatatcggaatgcaatgaatgtgctatggaccttaagcattactagaatagttcgcagacaactttgtcataaggctccgcgacgcaatttaacgatactatatcaataaaaataatcagctatatctctgttaatatcgccaattcttacgttgatcaatattgcttgccggagcttatcatcttttatagggaggaggcccgtagaggactttacggtatataagcccaataacttctgccaatggtgccgtcaaaatagatcggagtttccagatataaagctccaataagaatcgctgacacaacgcagcacagggtcgaaacttacgcaatagtggcctaacagactgaaccaagtggaaaatctaaggagtaacccaatatgattgactgtgaataagaaattcattcctgaggaataaccgtcaccacttactctaaaccctaataggaataataattattaaaatgaggacagcgtacttaatgtcatgctcgaataaaatggtcctatagtgaactagattacctcctatgagaaagttaagaacttaacctggatgtctctactcacatgatctacctgcatgtgtaatacacgagtcaacatattaacacacaaaagttctttcttccatatgcagttatgtaagtcatagctgtattccataaacctatcaaagtcactatatctggttatctaaagtctagagaaatggatagtcatttatggtaatatctcaattaagtataattgtgataaaatgtgtgtagtggctcctattttcccgactttcactgtgagatgattaaacaagtacacacttgttatttattataagctcatgtgcaactaccctatcacgagaccgatccgacaggtgaagcatatataagaaactcatcacgtctgcgtaattaaattatacaccagtcgtaaaatcgtactttactaccagtttaacatgcgtatggtgcaaccctacatacacgatacctgaaaatcgtaatggacttagtaacagatagctaaaacggtattccgaagcggtgcattaattcactaaggtatggatgttctcattacacggcttagatacaattatagtggcaaggaacataattagttattaccatcggcgacgaatagtagtttatttccttcctgtgggctcctcctgaaatgccacttatacggcatattgaagccgattagtacaatagatttattcaacctcaaaggtctatattcccggcttactcttagctgatatgtcgcgtcaagtctcgggattgagtgcattagcaccggattgtctggcttagttcaactattggatagctcatcgggttatactaactgacacttattctttaaataacgttcccttattaggactagtaactgagatttgaaactatccttatttctaatcatgttaactctttcgcatgaataacagtacgagcttactttacgagataatctcttattcaagtgcaggatactcttccaattcttgaagaggacgtagagtgttgaatgtattagaagggcgtacgcattatctgcccacttgtatatttatgtgttttcaaggaaggaagtatgcatcaattcgttcagtatcgacataaggtatttggaaagttttagtgacatagtccaatagattcttgatctccttaccgatcagtaaataccattatacagtcaattcagatctacgctatttaacacataacgccgaggataaaagggctgaaattgacagactacaatattgtttatgtgtcatcaattaacaataaacgaatacatgttgatgcgatagagctctggccaggccgtccacttcgtatattttctttgagtagtgtagatgtattaatatagcatgtagccagattcttagcatgaagcgaagattaaaatgtacgcatgccacgttcacatatatgtgctttagatttttagtgttacctgaaacatagtccatagattttcctttaagactacggcacgaagttaagtgatttcacacctacaagagaaatatgcccaaactatgataataacaccgttcgttgaattaatcaataatgatagcggttgcatattatcaaatgaaggagccacacccggggagcagtttacggtcgatatctcgtacaacttcggctaatcatgttatctaaaaaagttgaggtttgcagttgtcagggcgaaatcagattcgactatatagcccagttcagagccctaactcacgtattcgtgaccttagagagcgagtcaagctaattactcattgactagctcaatatgaggcagtgtgaataagaaatttattgcaaggcaataatcctaattattgatagcaaactttgataaggttgaagaatagcacaattcagaaagcgttctttctgtcatactcgaatgaaatgctttattaaagaaaaggttgatgtcctacgagatgattaagaacttcttctgcatctcacaacctacttaatcttcggggatgaccaaaacagtcttcgatgtcttaatgacttatcgtccatgaatcatctattacttccatttcgcctgactgttcgttcaaatctgcaccactaactacaaatattagtttaatttttattatcctctaaatgcgataaattgtgtattgcggctcctattttcccgactttaactgtcagatgttataacaagtacacagtagttaattgttatttgcttatgtgcaactacgctatcacgagaccgatccggcaggtgaagcatataaaagaaactcatcacatctacataattatatcgtacatcggtctaagaatcgtactttgcttctaattttacatgcgtacggtgcaactgtatatacacgaaatctaaaaatcacaatggactttgtatcaggtatctaaaaggaaattctgatgccgtgctttaattcactaaagtgtggatgttctctttatacggctttgatactattattgtggcaagcaacttaattagttattaccatcgccaacgtataatagtttacttcctcggtgtgggcccctcctcaaatgccagctatagagcatgttgaagccgattagtacaatagattttttcaaccccaaacgtcaacagtcccgctttagtctaagctgatatgtcgggtcaagtctcgggattgagtgcattagcactggaatctctcgctcagttcaattaatggataactcatcgagttatactccgtcacacttattctttaaataacgttccgttattaggattaataactatcgtttgaaactattccaatttcttatcgtgttaagtctttcgcaagaaagacagtatgagcttactttacgaaataatttctttttcaactgcaggatactctactaattcttgaagaagacgtagagtgttggatgaattagaagcccctacccattttctatcgacttgtatatttatctctattcaaagatggaagtttgcatcaatttgttcagtatcgatatagggtgtttcgaaagtattagtgacatagccctatagattcttcattaccaaaccgaacactagttagtattaaacagtcaattctgttctacgccatttaacacataacgctcaagataacagagctgaatttgagagactacaatattgtttatgtgtcaccaattaacagttaacgaatacatgacgatgcggaacacctcgggccaggccgcgcacttcctatatttactttgagcagtgtaggtgtaataatatagcatgtagcctcatgcttaacttgaaccggagataaaaatctatgcacgcgaccttcacatttacaaggtttagatttttaatgctacccaaaacaaagtccataggtttttcattaagactacggcgcaaagttaagtgatttcactcctacaacagaaatatgcccaaactatgaaaacaacatggttcgtagaaataatcaatcgtgatagaggttgcatattgtcaaatcaaagagccacactcggggagcagttgacggacgtcatcacgtgcaatttcggctaatcttataatctataaatgttgaggtttgcagttgtcagggcgagatcaaattcaagtatatagtcctgtccagagccttaattcacatattcgcgacgcttgaaagcgcgtcatgcttatcactgattcactagctcaatgtgtggcaatctaagtaggaagtctgttgcaaggctaaaaaactaaatattgatagctaccttagttaaggtagaagaattgcacaattcagtaggcgttttttctgctatactcgaacggaatgctttattaaagtaaagcttgatgtcccacgagatgaacgagaacttctataacatctcacaacctactaaattttgggggatgggtaaaagttagctgaacatacaaataggaatttgattgtacccttagacgaaactaaacaaatcatagtaaatccgcacaaagtttacatattaattcatacggcgtttcaaagaggcaatggcttgacttgtggtgaattacagtttgtgagtaaccacaagatgcggtaaatactgtaatccgagtttaattgactcgacttaaagattctgatattataatgaaaacacaatggtttattgtcaattacttatgcactgttacatcttgtggtcctcggtccagcctgcgtaggatataaatgaagcacgtctcatccagattgatctatcgtacctccaaatacgaattcaacttggcgtctatatccagaaatgagccctagaagtgatagacttccaaatctttaaactaccatgggatatgtttcacgtatccaaaaagtaattataattctgcgtttccattcacttaagtgaggatgtagcctttatattggtttcatagttttgttataccaagcatgtattttacctagcactattttcaacctaaaactgttttgtttctcgatgtcaaacccttgtcagctacctgcggtggtgcacgaaaaaaccgattagaatattaaatatttacaactccaaattttaagagccctgctctagtttaaattcatatatcagtataggcttcgcaatttagtgaataagcggtatgaattttcgcggagtatgaaaagtgactaagtaatcgagatacataccgttagatagatgcttcagactgcattctgaatttttgatttataaccatcgaaggaatcaatttcatgttcctaacgtgttaagtcatcagtaaaaaagaccataagggctccccttttgaaataatactgtttcaaactataggctgccctacttggtgttcaagatactatagagtcttcgatgatttaaagcccccaacccatgttcaatcaacttctatgtttaaccttaaactaacacaggaaccagctaagatttgtttagcatcatttgggcacgttacatatataaaataaagtatgccgcagagtttctcccttaccgaactgtagtcgacctaaagtctaatactcattggtgttgtatcacttttgtgacattaggtatgatttaactcttgaaaatttttacgactatgataaaagattagagctaccaaataactgttaataatcatgtcactatgtagatcgccaagaatcagctgggatgaatgcattatttacatcgtgcaaactaggtctgagtaggtaccatcgtagtttatgcctaagttgaaccgcaaatataggtcttttgccgggatctccactatctgtaaattgtgaaacctgttggtaacctatacaaaatacatagctatatcattagtaataaaacgtaaacgaaagatcattcactccttcttcggaaagataaccaaagaattaggagaatatggtgcgcacatagaaaggatcgggaaataactttgaccttcacagaacaataagttacaatttgggaacagtcggataacgccactacgtgcttatttggtttaccttaaattttataattgatgaggattaaaattcacgggagaagatctaacataagtatatagttatatctgaagcgtttgaacacttactccctttacttaattaggccttattgttttccctgactcataagttctatgattggcaatctatctacaaggagacacgtatcatttaaaaacaaaaaattggtaacttccttagttaaagtgctgggaatgctcaaatcagtagtcttcttctctggaaatcgcgaggggggaattttatcatgtcgaagtttgttattggactcattcaaccataggctccatgatattaaaagagctagtaaactacgggggtaggatacaaatttcttgataatagaaatcggaattcgaatgtgtccttggtcgactcagatccaatccaagtgaacccaacgaatgtatatattttattacatatggcgtcttaaacagggaatcccttaacatcaactggttttcagataataagtaaccgcaacatagtgaaaacacagttatcgatactagttagagaacctttaataatgctacaaccattttctaatcttgatgatttgttgacaattattagttcagcgagccatctaacggttcttagtcaactctacttatgcaataaatcttgcatgtttgacgctaactcaaccatggtagcatcaaatacggatacaattaggggttaatatgcagaaaatgggcttagggatgatagacactttacaaattgcacaagcaatcgaaatgttttatgtatcgatatagtatgcatttttatagaattgccttctagcatgacagaaacaagcctatctattcgtttctttatcctcctataccacgtgtgtacctttcccggccattcattaagaccggaagtatcttgttatacaatattaaacctttaacagcctatcgcgctgatacacgaattaaccaaatgaagtttaaaaaattaactactgttatttttaagtggcttcttcaagattgcattcatatatcaataatgacttactaaggttctaaatgagagaattcaattaatctggataaacaaaagggtctgaagattcataataccaaccattaaatagacgttcctctgtgtatagtaaatctttattttttaacctttgaagaaatcgacaacacgacccttgcgagtatagttatgaaaagaagagatcttcatctttgcccccttataatagtacagcttcaaacaatattctcagtaagatggtatgtgtggtactaagactttcatgactatttgatgtccttattctatgtataaagagtaataatcttaagtctggagtttactcagcaaccagttgagtctaggcacagctttcttgggttgcttatatattgaaaataatgtactcaacaggatcagtctcataaggaattgtgattgaccaaaagtccgctatgcattgacgtcgtctcagtttagtacctataactatcatcattcttttggtggctattacaatgttggtaaaagaataaaactacaacacatctgttaataatcaactcgctcgattgattgtcaagaatgtttagtgatgagtatgttatttaaggcactcgagttgtgattgagttggatccattgtagtttacggctatataagtcctcaataatacgctctatacgcaaattcctattatctgtgaaatgtttaacgcgtacgctaactctataaaatacttaactatattatacgttagaatatcttaacggacaatcgcattgtatttatttgtatagattaatgaaaaagtaggtgcgaatattgtaggtatggtaaaggccggtaagtaattctagccttcatggaacgttatgttttaatttgaaatttaagggatagtgcgtctaaatcgttaataaaattagttgaaatcacctagttagaatctgtaaaaattcaccataaaagttccaccgtaaattaatgattactactgtataattccaaaatttactctcttaagttaattaaaccaatctgtttccctaggcttctataaaatagcgtcggtaattttcccgcatggagacagatgttattcggaaataaaaatttacaaacttctttggcacttctgctgacaacagttttgtttatactattcttgtcatgatgtagatacgacgcgttattatcatgtcgaagttcataataagtgtcattttaccatacagaccatgattctgaaagtactgacaagctgcaaatatgaaattcatatttctcatcacaaggctacagacctctaataagatgtacgttaactgagattcgtgtcggtagaaccgaacgatcatgtaactttcactatatgagttgacctgctttgagctttcctttatactaactggtattctggcgaaacaaagctgtagcagaatcatgtcatgagtattaatagtagtaagaaaatcacggataatgttacaaccgttttcttatttagaggtagtgtgaagaacttttacatgaaccagcaaactaacatctctttcaaattactactcatacaataagttccgtgacgacatgactatctcaacctgatttacaattaatgctcttatattgagaagttattaagcgagatatgcatttaaggataatagacacatcacaaattgcggataccattgagacattttataaatagatgcaatatggaatcttatagaattgcctgatagcgttatattgatgaacatgactaattaccctttcacccacgctattagcttccataccatttgcggccattcattaagatccgttgttccttacaaaaaaaaaattaataagaaattccgtaacatgcagatttagtagttattataaacaactttactggaacaaactaaaacatttataaacagaattttgatagtggcaattaatttctaatgatgtgatattaaggtctaaaatgtaagaattcgataaattagattagacaaggggatccgaagatattttagcgcagttagttatagggggaacctctgcctacaaaaagcgtttattgttaattgtttaaagatacagtgaaaacgacagtcgttaaaacaaaaatgatatgtacaatactacatctaagcagcgcaataacgcaacagcttgaagtatttttcacagaaaaatcgtacgtccagttctaacactttcatatgtgttcgtcgtttatgcttttagtatgaaaactagtgtgccggtgtctggagatcatccttcttgcatatgactccaaggacagccatcatggtttgtaagttcattgagactgttacgcttaactggacgaaactcgagaagatatatgattgatcgtaagaccgctttgattcgacaccatcataacacagtactcatgattatcatcatttttttagtccctattacaaagctgccaagtgaataaatctctatcacactctatgaaaatgcacttgatcgttttattgtagaaaaaatttaataaacagaatgttaatgaaggcactactgtactaatagagttgggctatatgttaactacaagactataacttattaataactcggtctatacataatttggtatcatgtatgtagtgttcaagggctatagcaattctgataaaaatttattaaggtaacaccttagaataatatactggtctatcgcaatacaaccacttctaccgtataatccgagagtggccacgataatcgaaggtatggtcaaccgttgtaagtaattctaggcgataaggaatcctttttttataaattttctttaggacattgttcacgtaaattatcaagattaattgttgtaatgagctcgtttgattttgaaaatttgtgtcttaaattcgtctccgattaatacactatactatactttaatcccagatatatcaatattaaactatttaatttaatctaatcctcaaaccttctattaaatcgtgtcaatcaatatctgcttcctaaatggaagtttttcgccaaaaacaataaacagaatttaaagtcgcttttgtcctcagcaattttgttttttttatacaggttataacgtagattcattccgttaaagcgttgtccaattggataaaaaacatctttttaatctccaggtcaagtttgtgaaagtaaacacgtcgagcaaatacgtataccgcacatttgaccacgcagccacatacctctggaaggaaaaacacatactaacctacctgacgctagtgcaaaacattcaagaaactctgacaatgcgaattaacgagccttaaactcttttatttgctgataagcattattgcgaaactagcttgagcttgtattgtctggtgtgtactattagaagtgaaaaaatcagggttaatgtctcgtcgcctcatttatatacagatagtcagtgatacctaaacgtatactagcaaaatgacatcttaattaaattatttatcttacatattcttcctagatgacatgaatatgttggtccgatgtataattgatgttctgatataggataataactgaaacacatatgtattataccaaagtatgtacatcacaagttcccaatatcgtttagactactatttactaatcccattgtggaatcttaatatatgatcggatagccttgtgttcgtgaaaacggcatattaggctcacagcggtgctattaccttccataccagctagcaacaacgataatcatccgctattggataggaaaatagtatttaaaagaaatcttgtaacaaatgttttatatagtcctaattaactacattactcgagcgaactaaaacttatgatcacaaaaataaagctgagcctaattatgtgatatgatttaaaatttcggtctatatagttataatttgatgaaataaattggattagcagtttgctagatgatttggcacagatagtcatagacgaaggacttactatgaaatagcggttttagttgtcaatgttggatttcagcgaaagcaggaatcgatgtagctaaagaaatatgtccatcattgcatttagataaggcatcttgccaaaaagagaaccaatattttgtaaagaaactagaggtcctctttatactctatgatttgtgcagctcttaaatgcaaacgacgagtaaacaggtgcgtgggtgtatggagaccttcatttttatgtatgattggatggactacgatcacattttatgggttctctgcgactgtcacgctaaattactcggaaattgacaatgtaatcgactacttgtaataacccactgatcgaactggagcataacgggtcacacatcataattttcactattttagtccgaattattcagcatcgcagtaaatgtataacaatcggccactgtccatttacatatcatcgtattccattagaattaatttaatatatagaatgtgtaagtaggatctactgtacttatatgaccatgctacatattaacatgaaaactatatccaattcttgaccttgtgtatatataatatgaatacgaacatgttggattcaaaagttatagcaaatcccatcttaaatgtttagggaaaggctttagtattatattctagcctattggaacacaagcacctttcccatgtaaacccagtgtcttcaccataatgaatactttcatcgatcgttattgcttttagtacatgatgactcgtccttttaacataaattttctactgaatattcattacaaaatgtaccaggattaaccaatgtaatgagcccccttgattttgggtactggtgattttatttcgactcagatttacacactaaagtaaattttaaagctagacatacaaatattaaagctctctatttaacctaaacgataaacaatcagctaaaccgtgtcttactgagtctgcttcttgaatgatactttaccgccaaagtcaacagttactacctaaagtcgctttgatcttttgctacaccgaattctttatgaagagagtaacgtaaatctattttgtagaacgatttttttctaggtcatgaaacatttcgttcatctctaagaaaattatgagacattaaacaggtcaagaattttcgtttgctcctcattagtccacgcacccattttcgtttcgatgtaaaaattcatattagtctatctgatgctaatctaatataccctagacacgctgacagagccattatgtgagccttttactgttaggttaggtgttgttcgatactgggtgactagcattacctcgtattgcccagagtgtggtatttaaaatggtcaaattaggctctaaaagttgtaacgccatctgcacattgttggctggtgaccggtagatgtataataatataaggtattcaaaattgaattaaatatgctttgcgctcatcctacatgagataaatatagtggaacgatgcataattctacattcgattcaggttatgaacaggaactcgtatttaaagtttttatcgttcaaaaacctaagtcttcaataacgttttgggtgggatttgcaaaccccttaccaaaatcgtaatataggattggataaacttgtcttcgtggtaagggtacaattgggacgctgaagtagtgtaacttatgagaaaggctaattataacaaaaattaaattctagtgaggtggaagattgtattttaaagatgactaataaatattgttatacatgctcctaatcggttctacggctcgcgggcaccaaaacccatgacctctaaaataaagctgagtttagacgcgtgatttcatttaaaatttcaatctgtttgtctattatatccagagatatactgcatctcctattagtttatcgatttcgcatacaatgactcagacaaagaactcactatggaatccgagaatcaggtgccaatgatcgttccgatcaaaacatgaaagctatgtggcctgacgaatacttctctcattgtttttagataaaagatcttgctgaaataggatccagtactttgtaaagcaagttgagaatcttataatgttttgaagatcatcgggttctaaaaaccaaacgtggactaattaggtgcgtgggtaaaaatctagctacatttctaagtagtttcagataaattatgataagtttatatgggatgcgtacgccagtctgcataatactttgagagaatgacaatccaatctagatcaagctatgaattacaaacggttatgaagtaaaacgggtgttacagcttaaatttagccagaataatttaggagtttcaacattgccgtagaggtgtaacaactcaccagtggccatccacatattaatatattccataacttttaactaattttatttgtaacgcgggcaaaatatattttgtttaagtctgcttgctacgatcttagacataagcttggttcaatactcgcgcttaaagaaaaatttcaaaaacagcaagtttttggactctcaaattgttacaaaatgcaccctgtacgttaggggaatggttactactttatatccattcttgtttagacagaagcacgattcccatgttaatcctccaacttcattacattgaatatacgttccctttaattttctatttgatttaaggtcattccatcatctaacactaaatttctactgattatttataacaatatgtaggaggattaggcaagatgcgaaatgctggttgtttttggttctggacattttatctcgaattaaatctgcgcattaatatgaattctatagattgacaagcagaaaacataggtctctttaagacaatgggaataattaaatacctagagcataaattactgagtaaatatcttgactcatatcatagattcctagcccccggttgctaggaaggttagtcttgtagtttccatagaccagactgctaaagaagagagttactgatatcttttttttagggcgacgtaatcctagatgatgattcatatggaccaacacttagaatattacaaatcttctagttacctaatatttttgatttgcacctgggaaatcattgcattcgattttagatcggtgtaaagattgatcaaactccatttaattttatccaaatttaccatatgcatgggataacacgtattatgaaattcacttttcgttaggttacaactagttcgagacttattgtttgctaatactacattatcctcacattagcgaatgtaattggctctctaaaaatcctcatagttgtaatgggaagccgagattattgagtgatcaccagtagctgtactattttataagctattaaaaattgattaaaataaacataccgcctgtaatatataaatcatagtcagacgaacattgctacaatctgtattcgtaccaagttatgagcgcgtatttcttatttaagtttttgtcgctcacaaaacactgggtttaccaatcattcacatgggacatgcgatcgtactgcctatgatgatatattggtaagaagttatctgtctttcttctaagagagcaattaaaaggttaaagaaatgcaatatatatgcaagggaaattaatggataatcttaattcctgtaaggtagcacattgtgacttaaaaatgactaaataatattgttgtacatctagctaatccgttctgggctttacgaccaacagtaacgaagacctattaaaaagaccttgatatggacgcgcaactatagttaagttacctagatgtccgtcttttctattcagccaaattctcttacctttttcaatctttggatctcataattaatagctcgtttatagaagagtatatactatctaagggtggagggccaaggatccttccaatcacaacatcaaagatatctggactgacgttttctcctctcaaggactatagaaaaaaaatcccattgcattaggatctaccacaaagattacctggttgtaaattttgcaatgttaagaacatcaatggatcataaaaataaaacgtgcatcctttagtaacaaaatctaagatctagacaaatttccaactagtctgaacttagattaaagaggtttaataggtacacgaactctgtcgtatatattactttaagtgaaatgttttccagtgttgatcaatctctgaataacaaacgattataatgaaattagagtgtaaacgttaacaacgaccgagagatttttagcagcatcatagttacctctcggctctagtatctcacaaatggtcatcgatttgataaattgctcgataatttctatgtactttcatttgtatggcggactttataaatttagtatcagtctggtttaaacgatgttgagcataagtgtgcttgaaaactgccacataaagggtaaattcgaaaacaacgagtgttttgtgaaccatatgcataattagagtaccctgtacgctagcatgacacatgcctccacaaagctattcttcaatacagtataaatagattcattcgtctatttttctatttatatgcgttatatttacgttgtctttaattacctgctagaattaaagacattccattgtgtaggactgagttttcagtaattcattatattaacttgaagaccaattaggcaagacccgacaagttggttgtgaatgcctccgaataattcttctaaaactatgcctgggtgttgacagcaatccattgaaacttcaggcagaaaagcttagccggtttaagtgaatggaaaaacttagaagcgttctgtattgattatcgaggaaatattttctcatttgtgacagatttccacctcccggttcttaggaaggttaaaggtgtaattactattgacgtgactgcagaggagaagagatcttgttttcattttttaacggtaacgtgatcctgaatggcgtttataatggagcaatatatttaacgtcggaattcttgtagttatctagtatttttattttgtatataggagataataattttacattcaagatttgtttcatgcttaatcagtcttgaatgtaatttctctaaatcatccatgtgccagagacagcatatttaatgaaataaactttacaaaaggtcataattagttagggagttatcgtatgttaatattactctgatctgatatttgcaatcgctgctgtctctccaatattcgccgtaatatcaatagagaggcgagatcatactgtgttttccaacggcaagtctatctaaccagttattagaggaacttgatagcagacataccgcctgaaatatttacatcttagtcagattaaatttactacgactcgtaaacacacgattttttggcagtgtatttcgcatataagcttttgttgcttacaggacacttggtatacgtaatgatctcatgagacatctgttcatactgtgtaccgaggtgttccgataaatagctatgttatatttatctatataagccgataaaaagacaaatataggcattaaaaatgcaacaaatattaatgaacggtctcaattagtgaaaggtatcgctccttggcccatatctcaaaaagcgatatattcgaactactgatgaagcccatcagggctgttctatctagacttacgggagcttattttgaggtttttgttacggaccgacaaccgtcgtgacgtaactttgaagtccgtctttccggatcgaccgaattggttcacctttttgaatcttcgtaggattatactaatagttgctttttgtaaaagtaaacactccctataggtggtggtctatgagtttttccattatccttattattgataattctactcatgtcacctctactatagtacaaatttattatactaccattgcactagatcttacggcgaatactctctcattacataaattggagcctcagggacatcaatagatgataaatataaagtttatgtcctcaattgtaaaattgtaagttcttaacaaagtacgtattagtcagaacttacattaatgacattaggtatttacacagtttctgtgatatagattagttcatttcaaatctttttccgtattagttaatgcctcaatagaatagaattataataacactatattataaacgttagcgacgacagagaggttgaaagcggcattctagtaatctgtccgttcgagaacgatataaaatgttcccgtacagattgataggttagtattctccctgagctgtcgtctccatgacggactttatagtagtacaatcgctttaatttaatacatggtcagcatttctgtgccaaaaaatcgtcaaataaagcgtatatccgaatacaatgaatgtgctatggaccataagcattactagaatactccgcagacaactatgtcataaggctccgcgacgcaatttaacgatactatatcaataaaaataatcagctatttttctgtttatatcgctaattcttacgttgattaatattgcttgccggagtttatcatcttttatagggaggaggcccgtagaggattttacggtatataagcctaataacttctaccaatggtgccgtcaaaatagatcagagtatccagaaataaaactccaataagaatggctgacactaggcagcacaggatcgaaacttacgctacaaaggcctaacagactgaaccaagtggaaaaactaagaagtatcccaatatgattaactgtgaataagatattcattcgtgaggaatatccgtcaccacttactcaaaaccgtaataggaataataactattaaaatgaggacagcgtacataatgtcatgctcgaataatatggtcgtatggtgaactagaatacctcctatgagaaagttaagaacttaacctgggtgtctctgttcatatcttctatttgcatctgtaatacaggagtcaacatattaacacacaagagttctttcttccatatgcagttatgtaagtcattgctgtattccataaacctgtcaaagtcactatatctggttatgtaaagtctagagaaatgcatagtcatttatggaaatatctcaactaagtataattgtgataaaatgtatgtagtggctgctgtttttccaactttcaccgtgagatgattaaacaagtacactcttgttatttattataagctcatgtgtaactaccctatcacaagagcgatccgacaggtgaagcattaacaggaaactcatcacgtcagcgtaattaaattatacaccagtcgtaaaatcgcactttattagcagtttaacatgcgtatagtctaaccctacatacacgatacctgaaaatcgtaatgaacttagtaacggatagttaaaacggtattccgaagcggtgcattaattcgctaaggtatggttgttcttattacacggcttagatacaattatagtggcaaggaatacaattagttattaccaacggcgacgaatagtagtttatttccttcctgcgggctcctcctgaaatgccacttatacggcttattgaagccgattagtacaatagatttattcaacctcaaaggtctatattcccggcttattcttagctgatatgtcgcgtcgagtcccgggtttgagtgcgttaacaccggattgtctggcttagttcaacttttggatacctcatcgggttatactaactgacacttattctttaaataaggttcccttattgggactagtaactgagatttgaaattatccttatttctaatgatcttaactctttcgcatgaataacagtacgagcttactttacgaggttatcacttattcaagtgcaggatactcttccaattcttgaaaaggacgtagagagttgaatgtattagatgggcgtacgcattatgtgctcacttgtataattgtgtgttttcaaggaaggaagtatgcatcaattcgttcagtatcgacataaggtatttggaaagttttagtgacatagtccaatagatttttgatctctttaccgatcagtaaataccattatagagtcaattcagatttacgctatttaacacacaacgccgaggataaaagggctgaaattgacagtctacaatattgttcatgtgtcaacaattaacaataaacgaatacacgttgatgcgatagtgctctggctaggccgtccacttcgtatattttctttgagtagtgtagacgtattaatatagcatgtagccagattcttagcatgaaacgatgattaaaatgtacgcataccacgttgagatgtatgtgctatagacttttagtgttacctgaaacatagtccatcgattttgccataagactacggcacgaaattaagtgatttcacacctacaagagaaatgtgccgaatctatgataataacaccgttcgttgaattaatcaataatggtagcggttgcatattatcaaatgaaggagccacacccggggaggagtttacggtcgatatcccgtacaacttcggctaatcatgttatctaaataagttggggtttgcagttgtcagggcgaaatcagattcgactatacagcccagttcagagccctaactcacgtaatcgtgaccttacagagcgagtcaagttaattacctatcgagtagctcaatatgagagagtgtgaataagaaatttattgcaaggcaataatcctaattattgatagcaaactttgataagaataaagaatagcacaattcagaaagcgtacttactgtcatactcgaatgaaatgctttattaaagaaaaagttgacgtcctatgagaagattaagaacttctcctgcatctcacaacctacttaatcttcggggatgggtaatagataggtgaacatataaatagagataagtttctaccttcaaacgtagttaaacaagtcatagctatatcccacaaacctttcataatcactgtatcgggatatctaagaagtaatggtatggctagtgatcaatcataatttgtcagttaagacaagatgcggtaaattgtgtattgcgagtcctattgtctcgacttaaactgtctgatgttataacaaatacacagtagttaattgtcaattgcttatgtactgctacgccttgtggagaccggtccggcgcgtgaaggatataaatgaaactcgtcacatccacattattatatcgtacatcggagtacgaatcgaacttggcctctatttttagatgcgtgcgctgcaagtgtaaatgtaccaaatctaaaaattacgatgggttttgtttcaggtatccaaaaagtaattctgatgccgcgcttcaattcactaaagtgaggatgttgtctttatacgggtttgatacttttattgtaccaagcatctttattagttagcactatccccaacgtataacagtttactttctcggtgtgagcccctcgtcaactgcctgcagtagtgcacgttgaagccgattagaatattagattttttcaactccaaacgtcaacagtcccgctctagtttaagttcatatatcaggacaggtctcggaattaagtgtataagcgctgggaactttcgcgcagttcgaatagtgagtaagtgatcgagttacacaccgttagattcatccttcagataacgttccgtttttttgatttataactatcgtttgaatcaattccatcttcttaacgtgttaagtcatccgcaaaaaagacgatatgagcttaccttacgaaataatttcatttcgaactacagggtgctctacttgctcttgaagatatcgtagagtgttggatgaattaaaaccccctacccattttcaatcgacttgtatgtttatccttaaactaacatggaaatttgctttgatttgtttagtatcatttaggcgtgtttcaaatgtataattaagtatgccgcatagtttctccattaccgaactgaacaccacttagtgtcaaacactcattgctgttctacgccatttatgacattacgctcaaattaactgagctgaatttcaaagactataatattatttttgtgttaccaattaacagttaacgaatacgtgacgatgtagaacaccaggagccaggtcggacgcatcctatatttacttcgtgcagagtaggtctaacaagatagcatggaggtttatgcttaagttgaaccgcagataaaggtctatactcgggatcttcactatctgaaggtttagaattttaatggtaccctatacaaagtgcataggtttttcattaatattaagacgcaaaggtaagtgaattcactcctacaacggaaatatgaccaaagtatcaaaacaatatggttcgtagaaaaaatcgatcgtgataaaggttggattttgacaaaacaaagagctacagtctgggaacagtcgatggacgccaccacgtgctttttcggctaatcttataatttataaatgttgaggtttagaattctcgggacgagatcaaatttaagtatatagtcatatccgaagcgttaaatcacttattcgccatgcttaaaagcgcctcatgcttttcactgattcattagctctatgtatggcaatctatgtacgaagtctgtcgtaagacttaaaaactaaatattggtagcttccttagttaaagtacaaggattgcacaattcagtagacattttttctggtattcccgaacggaaagctttattaagacaaagtttgatatccgacgggatgaaccacaagttctatgatatctcagaagctactaaatttcgggggttgggtacaagttagttgaacatacaaattggaatttgattgtatccttggtcgattctaaacaaatcgtagtaaacccgtgcaaagtatatatattatttcatacggcgtttcaaagaggcaatggcttgacatgagctggatttcagattatgagtaaccacaagatagtgtaaacactgtaatccatatttaattgagatctcttaaaaatgctgatattattttctaaactcgatggtttattgacaattatttgtacagtgatacatctagcggttcttggtcgaccctacttacgtaataaatgtagcacgtttgatccagactcatccatggtagcttcaaatacggattcaacttggcgtttatatccagaaaacggccctagaggtgatagacatttaacactttggacaaccattggatatgtttcacgtatcgatatagtaattattattctgcatttgctttctagtaagtgaggaagaagcctttctattggtttcttaatcctcttataccacgcgtgtatctttcctagccctttattgaaactggaagtgtcttgttattcaatgttaaacccttgtcagcctattgcggtgatgcacgaaaaaaccaaatggaatataaaatattaactactcctaattttaagtgccctcttctagattgtattcatatatcaatatagacttcgcaaactagtgaatgagggaaatgaatttatccggaataacaaaagggactgagtattcaagatacaaaccgttagatagatgttccagtctgcatagtaaatttttgttttttaaccattgaaggaatcaatttcacgatccttacgagtttagtcatcagaaaaagagacctttagcgctccccccttgaaatagtacagcttcaaacaataacctgagtaagttggtatccgaggtactataaatttttcgatcatttgatgcccccatcctatgtttaaagaactattatctttagccttaagcttacacaggaaccagctgagtctaggttaggttcacttgggttgcttacatatataaaataatgtataccgcagaatttgtcccttagggaattgtagttgaccaaaagtctattactcattggcgttgtatcacttttgtgtcaataggtatgatcaatctcttggaaattattacgatgttggtaaaagattagaactactaaacaactgttaataatcaagtcgctccgtagattgccaagaatcagttgagatgaatacgttatttagaacgtacaaactacgattgagttggtaccatcgtagtttatgcctatgttaatccccaattatacgtcttttgcccgaatccccactatctgtgaaatgtttaacgtgttcgttacctttacaaaatacatagctatatcatacgtaaaaatatcttaacggaagatcgtacactctttcttcggatagataagcaaagaaataggaggatatggtgcacacatggaaagggccggtaagtaattctggccttcatagaacaatatgttataatttggaaattgtcggatagcgcgactatgtgcttaattggtttactttaaattttataattgatgacaataaaaattcaccggagaagttctaacgtaagtatatagttataactgaacgattccaagatttactcccttaagttaattagacctatttgttttccctgactcctaagttttatggttggcaatttatctgcaaggagacacatatcatttagaaataaaaaattggaaacttctttagctgttgtgctgggaacgctcatatcaatacttttcttctctagaagttgaaaggggggaatattatcatgtcgaagtttgttataagagtcattctaccatacacaccatgattctgaaagtgctggtaaactacgggaataagatacatatttctcattattagaattcagacctcaaatgagtcgttggtcaactcagatccgaatcgaaagaacccaacgaatatataacttttattacatgtgttgtcttagtcagagtattccttaacattaactggttttcagacgatatgtaactgcagcagagtcaaatcatggatattgatagtagttagagaaccattgataatgttacaaccattttctaattttgatgttgtgtagacaattattagttgagcgagctaactaacagttcttacaaatctctactcatacaataaattccgtgagctcaacactaactcaacctaggtaacatcaaatgccgatatattcaggggttattatgcgagatatgcgcttagggataatagacactttacaaattgcgcatgcgatcgagatattttatgaatcgatataatatgcattcttatagaattgcctgttagcgtaacataaataaacgtatctaattacttttttatccacgcttattacatccgtaccatttccggccattcattaagatcggaagtaccttgcaatacaaaattaaactttaaataccctatcacgcagatttagcaattattttaatcaactttagtggatcaatcatagacatttttaagtggtattttcaaggtggcatttaaatattaatgatgacatattaaggttttaaatgagagaattcaattaatttggttagacaaagggatccgaagatattttatcgcaaccattaaaagggcgtacctctgtctacaataagcctttatttttaaatgtttgaagaaatcgtgaagacgactgttgtcaatacaaatatgataagaacagtactacatctttgctccgcaataatagtacagcttcaagtaatattcacagtaaaatggtatgtctggtactaagactttcatgactgttcgacgtttatactttaagtataaagagtagtgatccgatgtctggagattattctacatccaattgactctaagcacagccttcttggcttgctagtacattgaaagtgatatactcaactggacgagactcgaaaggaaatatgattgaccataagaccgctttgtttcgacatcgtcttagtacagtactcataattatcatcattcttttagtgcctattacaatgttggcaaaagaataaatctccatcacacttcttgaaaatgtacttggtcgtttgattgttgagaaagtttaatgatgagtatgttatttaaggcactggtgtactgatagagttggactaaatgttaattacgagtatataactcttcaataattcgctctatacgcaaattcctattatctgtgaaatgtttaacgcctatggtaactctgtaaaatatttatctacgttataccttagaatatcttaacggactatcgcaatatatctacttgtactgattaatgggaaagtaggtgcgataatcgaaggtatggtaaacgccggtaagtaattctaggcaacaaggaatgttatttttttaattattttttaaggcattgtacgtctaaatcatcaataaaatttgttgaaatcaccttgtttgattttgtaaaaatttgtcttaaaactatcaccgttaattaaagattactacactataattccagaatttacattcttaagctatttaaactaatctgtttccctaggcttctataaaatcgcgtcagtgattatcccccttggagacggatgtttttcgcaaataacaattaacaaatttctatgtcacttctgctgtcagcaattttgtttttactatacttgttatgatgtagattcgtcgcgttattgcgttgtcgaacttcataaaaagtgtctttttaccatgcagatcaagattgtgaaagtatagacaagcagcaaatacgaaaatcatatttttgatcacatggccacagacctctagtaggaagaacgtttactgaggttcgtgtcggtagtaccaaacattcatgtaactctgacaatgcgaattgacctgctttgagctcttctatatactaactagcattctggcgaaacaaagctgtggtagtattgtgtcatgagtactaatagtagtaaaaaaatcagggataatgtttcgacggttcacttatttagaggtagtgtgagatacttttacgtgaactagcaaaataacatctcttttaaattatttgtcttacaattacttccgtgatgacatgattatctcaacccgatatacaattgatgttctcatattgaaaaattattaagccagatatgtattaaagcatagtacatacatcacaagttccggatatcgttaagactatttataaataattccattgtggaatcttataatataacctgatagcgttatgttggtgaagatggcaaattacgctctcaccggcgctattagcttccataccagttggcaacattcattaagatccgttattccttaggaaaaaaatatttataagaaatcctgtaacatgtgcatttaatagttctaattaacaacattactcgagcaaactaaaacttttaaacacagaattttagcagaggctaataatatgatatgatatgaaattagggtctatatagttataatttgataaattaaattagattaggagtttggaagataatttagcacagttagttatagacgaaggatttgccttcaaaaagcggttattgttatttgtcttaagtttcagcgaaaacaggagtcgttaaaacaaaaataatatgtccaatattacatctaagcaaggcaatttcgcaacaggttaacctattttttgtagaaaaattagaggtccagttcaaacactttcatttgtgcagctcgtttatgcatatggtgtgtaaactggtgcgtcggtgtatggagaccttccttcttgcgtatgattgcatggactgcgatcacgttttgtaagttcattgagactgttacgcttaattgctcggaattcgagaaaataaacgactattcgtaataacgctttgatcgaactcgatcataacagagcacacatgataatcttcacttttttagtccctattacaaagcagcggagtgaatatatgtctatcagtcactatgaatttgcatatgatcgttttactgtagaattaatttaataaatagaatgtataagaaggatctactgtacttatacaaccaggctacatattaactacaagactatatcctattattgacttagtgtatacataatatggtttcatacatgtagtgttcaagggctatagcaaatctgatgataaatgattagggtaacaccttagaattatatactagcctatcggaacacaagcacttttgccgtataatccgagtgtcgccacgataatggaaggtatggtcgatcgttgttgctattagtaggcgataacctatccttttttcataaattttctttagaacattgtttacaaaatatatcaggattaattgatgtaatgagctcgcttgattttgaatactagtgtttttaattcgactcggattaatacactatactaaattttaaagccagatatatcaatattaaactacttaatttaacctaatcgtcaaacgatctattaaaccgtgtctatcagtatctgcttcctgaatgatactttatcgccaaaatcaatagttagaacctaaagtcgctttcgtccttagctacatcgatttctttatacaggtagtaacgtaaattcattccgtaaaacggtttttcacttggttataaaacatttctttgatctccaggagaaatatgagatactaaacacgtcgagaatttacgtttgctgctcatttgtccacgcacccacatacctctggaaggaaaaatacatactaacctacctgatgctagtgtaaaatacccaagagacgctgacagtgcgatttaacgagcctttaactgttacattagctgataaacattattgcgtgactagcttgacctcgtattgcccagtgtgtagtattagaagtgataaaatcaggcttaataagtcgtggcgtcatttacatattgttagccggtgacaggtaaatgtatagtagcataacgtaatcttaattaaattatttatcttacacattcttcctagatgacatgaatatactggtacgatgtataattgaacttttgatataggataagaactggaacacatatatattatacttatgcttgtacatcctaagttttcaatatcgtttagggtacaatttacaaatccctttccggaatcataatataagatcggataaccttgtgttcgtggaaagggtacatttgggtcacagtagtggtattacttatgaaactagctagcaataacgaaaatcatgtactactgagcaggaaaattgtatttaaaagatgacttataagtaatgttttacatggtcctaattgattacattactcgggggaactaaaacccatgaccactaaaataaagctgagtctaaatgtgtgatttgatttaaaatttcgatctatatatttataatttcgagagataaattggatttgctatttgttagtcgatttggcacagaatgactcagacgaagaacttactatgaaatggcggtttcagttgtcaatgatggatttcagcgaaactaggaaacgatgtggcttaagaaatacctctctcattgcatttagataaaacatcttgctaaaaaaagaaccagtactttgtaaagtaactagagattcttttaatactctgtgatttgtccagttcttaaaagcaaacgaggagtaatcaggtgcgtgggtaaaagcaaagctacatttttaagtataatcagatagactacgattacattatatgggatctgtgcgactgtcacggtaatacactcggaaaatgacaatccaatccacaactagttataacccactgatcgtaatggagcataacgggtctcacatcataaattttactaatttaatccgaatttttcaacattgcggtagacgtgtaacaaccgaccactggccatctacatattattatattccataagttttaacttaatatatagaaaacgcgagtaggatctactgtacttatatcaccttgctacatattaagatgtaagctaagtccaatacttgtccttgagcataaatttcaaaaataggaagtttttggattcagaagttatagcaaaacccaccctaaacgtttggggaatggttttagcattatatcctaacctattagaacagaagcaccattcccatgttaaccctgcgacttcatcacattgaatacttttttcgattaatattgtttttaatttatgatcactccaccttctaacataaattttctactgattatttataacaatatgtacgaggattagccaaggtgccgagcgcccgtggttttgggtactggagattttatttcgactcaaatctgcgcactaaagtaaattttaaagttagacatacagataatataggtctctatatgacgtaaaggataatcaaatagctaaagcgtatgttactgagtctgtttcttgagtgataccttaggctcttagtccacggttactagcaagactagttttgtactttcgatacaccgaactgcttatgaagagagtaacataaatctattttctagaacgactttatcctaggtcatgaaacatttcgttcaactcttagaatattacaaaacatcaagtagcccaagatttttggtttgcacctgattaatccacgcacccatttttagatcgatgtaaagattcattaaagtctatttgatactattcaaatataccctacgcatgcggtcagacgtattatgagactctcttactgttaggttaggtcttgttcgatactcaatgtctgccaatacttcattttgcccacaatgtcgaatttaaatcggtcatattaggtcctcaaagttgtaacggcatctccacattgttgagtggtcaccggtaggtgtataataatataaggtattgaaaattgattaaaataaacattgcgcccgttttatataaaacaaattcagtcgaacgatgcaagaatctgtattcgaaccaagttatgagcgcgaatttctttttaaagtttttgtcgttcaaaaacctgagagtttaacaatgttttacgtgggacatgcaatccccttaccaatgatgaaatataggtaagaacaaatctgtcttcgtgctaagggtacaattaggaggctgaagtaatgtaacttatatgcaagggaaattataagataaattaaattccagtaaggtagtagattgtgatttaaagatgactaataaatattgttatacatcctcctaatcggttctacggtttacgaccatcaaaatccaagacctctaaaatagagctaaatttagacgcgtgattatacttaagatatcaaactgttcgtctattgtatccagagatattctgtatcccttattaatttatggatctcgtattcaatgactcatttatagaactgagtatagaatctaaggatcgggggccaatgatccttccgatcagaacatcaaagctatctggtctgacgatttcttctctcaatgactttagaaaaaaaatcccgctgcattaggatctagtactaagtataccaggttgtgaatcttataatgtttagaagatcaatggattttaaaaactaaacgtggaccctttagtaacgtaagctaaaatctagccacatttctaactagtttgaggtaaattataataggtttatatggtatacgtaccctattgtgcataatactttaagtgaaaagcaatccaatgttgatcaagctttgaataacaaacgattatgatgtaataggagtgtaatcgcttatattaaccgagagatttttaggagtatcaacattacccttcggctctaataactcactagtggtcatcgacatgataaaatattcgataatttttaactaattttatttgtatggcgggcataatatatttagtatgagtctgcttgtaacgatgttagacataagcatggttcaatactcgcgcataaagaataatttcaaaaacagcgagtgtttcgtgtcccaaatagttagtaagtgtaccctgtacgctagcatgacggttactactatataaccattcttcaatagacagaaagaagattctctcgttaattttccaacttctttacgttatatatacgttccctttaattacctattagaattaaggacattccatcgtgtaacactgaatttctactgatttattataacaacatgtagatggattaggcaagacccgaaatgctggttgtcattgcttctggataatttttctcgaactatacctgcgcgttgatatcaattcaatggatctacaagcagaaaagataagtcggtttaagacaatgggaaaagttagatacctagagtattaattatcgagcaaatatcttctcatatatgatagattcctacctcccggttgctaggaaggttagtcttgtagtttctatagacctgactgcaaaagaggagagttcctgatatcttttttttagggtaacgtaatcctagatggtgtttctaatggaccaacatttagaacgttacaattcttctagttacctagtatttttattttgcacgtgggaaatcattgctttagattctagatctgtataaagattgatcagacttgaatctaatttgtccaaattatccatgtgcttgagacagcatatattatgaaattcactttacaaaaggtcacaactagttagagacttattgtttgctaatattactttaatctcacatttgcaattgttgctggctctctaaaaatcgtcgtagtatcaatggagagccgagattatagagtgtttaccagtagctaaactatttaacaagctattaaagatagatcaaagtaaacataccgcctgaaatatttaaatcatagtcagaccaaatttgctacaactcgtattcacaccaacttttgacggcgtatttcccatttaagcttttgttgctcacaaaacacttggtatacgtattaatctcatgggacatgcgatcgtactgtgtacggaggtgtttcggtaagaagttatgtcatttttatctaagtaagcagataaaaagataaaaatatgcaatataaatgcaagagaaattaatggacgatcttaattcctgtaaggtaacacatcctgactcaaaagtcattaaataatataattgaacttctggttaatccgttctgggctgttcaaccaacagttacggaggcttattaagaagattttgatacggacccgcaactatcgttaggtaactttgaagtccgtcttttcgaatcagccaaattcacttacctttttgaatcttcgcaagtcataactaatagctcctttataaaagagtaaacactgtctaaaggtggagggccaagaatccttccaatttccacattaatgataactgcactgacgttttctcttctctaggacaaaagtaaaaaattgccattgcactaggacttaccgcaaatattacctcgttatatatattgcagccttaagaacatcaatagatcataaaaataaaacatgtatcctctattattaaaatgtaagttctaaacaaagtacgaattagtctgaacttacattaaagagatttagtaggtacacggtctctgtcgtataaattactttatttgaaatgttttccagtattaatcaatccctgaatagcatacaattataatgagactagactataaacgttagcgacgacagagagattataagcagcatcatagttatctctccgctctagtatcacacaaatggtcgccgttcagatagattggtcaataatctccatgaactatcgtctgtatggcggactttataaatctagaatcagtctaatttaaatgatgttgagcatttgtgtgctaaaaaaccgtcacataaagcgtatattcgaaaacaacgaatgtcctgtgaaccatatgcattattagagtactctgtagacaagtatgacacatggctccacaaggctatttatcgatacaatataaatagatatattcggctatttttctgtttatatccgtaatttttacgttgtttttaattacttgccagagttaatgactttccatagcgaggaaccgggtattgagtttttcactatataagcttgatgactactttgggtagtcccgacaagttagatctgaatgccctcgaataatactccaaaaacaatgcctggctgttggcagcactgcattgaaacttcaggcagaaaggcctagctggcttaaccaagtggaaaaacttagaagcgtcctattatgattatcaacgaaaaacattttcatttgtgagagatatccaccaccggatactcaaaaaggttataggaataataactattaagatgagtacagtggagatgatatcatgtttagataatatgacggtaacgtgatctagaatgccgcttatgagagagtaatgtatttaacgtcggagtccctgtagttatctactatttatatttcaaatacaggagttaacattttaacattcaagaattgtttcatgcataatcagtcttgaatgtaattactgtaattcataaatgtgtcaaagacactatatctaatcaagtaaagtttagaaaaaggcataatcagttacggagttatcttatcttaatattattctgatataatatttgcaatcgctgctgtctctccaactttcgccgtaatatcaatagacaggcaagctcttgctatatttttcaagggcatgtctaactatccaatcataagagggactcgacagcagaggtactgcctgaaatatcatcatgttagtgaaattaaattaagtaccagtcgtaaagacacggttttttagcagtttatttcgcatataagcttatgttacttacacgatacctggtattcgtaatgatcttatgaggcgtctgttgatacagtattccgaggcgctgcgttaaattgctatgatatagttatttttattagtcgataaaaagacaaatatagcgattaagaatgcaacaaattataacgaacggcctcaaatagtagaaaatatccctcctccggccatctcctaaaatgccatatattcggattattgatgatggtcaccagggcagttttatctagtctcataggtgtttattttgaggttattcttaccgactgtgaaccgtcgtgtcgtagctttgaacccggtgtttccggattgtctgacttggttcacctttttgattcttcatagggttatactaattgacacttattctaaaagtaaacactccttataggtagtggtgaatgagttttagcattatccttattattgataattttactcttgtcacatgtattacagtacgaacttattataccaccataccactagatcttatggagaatactctctcaatacttgaattggacccacagagacaagtatagaagataaacgtagagattatgtcctcagttgtataattgtgagttctcaacaaagaaggtatacgtcaatacattcagtaacgacataaggtatttggacagtttcagtgatatagaccaatacatttcagatctctttacgtatcagtaaatgcctctatagagttgattcatattaacactattttacaaacgtcaccgacgacagagaggttgaaagcggcactctactaatttgttcatgtgagaacaatatataatattcgagtacacattgatgggatagtgttctcgctaggctgtccactccgtaattgtccttaaagtagtacagtcgcattaatttaatacgtggtcagcattttagcgtgaaataatcgtcaaattgtacgcatatcagattgggatgtatgtgctatggacttttagcattacttgaatcattccctatcaattttgccataaggcttcgccacgtaattaagcgattccataccaataagaataatgtgccgaatctttgttaatatcaccgattcttacgttgatcaataatgcttgccggtgcttatcatcatttaaaggaaggacgcccgaggaggactttacggtaaatatgcccaataacttcggctaatgatgttatctaaataagttggagtttccagatataagggccgaataagaatcgactatacagcgcagcacagggtcgaaactcacgcaattgtggcctaacagactgaatcaagtcgaaaacctatggagtagcccaatatgattgactgtgaataagaaatttattccaagggaataaccctgatcattgactctaaactctaataggaataaagattactagaatggagaaagcgtacttattgtcatgctcgaatgaaatgctccaatagtgaataagttcacctcctatgagaaggttaagaacttttcctgcatctctcaacttacataatctacccgcatgcgtaatacacgagtcaacatattaacacacaaaagttccttccttcatacgcagttaagcaagtcatagctgtattccataaacctttcaaaatcactgtatctggttatctaaaaactagagaaatggctagtcatttatggtaatatctcagttaagtttaaatgcgataaattgtgtgttgcggctcctattttcccgactttaactgtcagatgataaaacaagtacacacttgttaattgttatttgcttatgtgcaactacgctatcacgagaccgatccgacaggtgaagcatataaaagaaactcatcacatctgcataattatattgtacatcggtcttagaatcgtactttgctactaattttacatgcgtatggtgcaactctacatacacgatatctgaaaatcacaatggactttgtatcaggtagctaaaacggtattctgaagccgtgctttaattcactaaagtgtggatgttctctttacacggcttagatactattatagtggcaagcaacataattagttattaccatcgccgacgtataatagtttacttcctcggtgtgggcccctcctcaaatgccacctatagggcatgttgaagccgattagtacaatagatttattcaaccccaaacgtcaacagtcccgctttagtctaagctgatatgtcgggtcaagtctcgggattgagtgcattagcactggaatgtctcgctcagttcaattattggatagctcatcgagttatactctctcacacttattctttaaataacgttccgttattaggattaataactgtcgtttgaaactattcttatttcttatcgtgttaagtctttcgcatgaatgacagtatgagcttactttacgaaataatttctttttcaactgcaggatactcttctaattcttgaagaggacgtagagtgttggatgtattagaagcccctacccattatctatccacttgtatatttatctcttttcaaagatggaagtttgcatcaatttgttcagtatcgatatagggtgtttggaaagtattagtgacatagcccaatagattcttcattaccataccgatcagtaattaccattaaacagtcaattctgttctacgccatttaacacataacgcccaggataacagagctgaatttgacagactacaatattgtttatgtgtcatcaattaacagttaacgaatacatgacgatgcggaacacctctggccaggccgcgcacttcgtatatttactttgagcagtgtaggtgtaataatatagcatgtagccacatccttagcttgaaccggagataaaaatctacgcacgcgacgttcacatttatatggtttagatttttagtgctacccaaaacaaagtccatagatttttcattaagactacggcgcgaagttaagtgatttcacacctacaagagaaatatgcccaaactatgaaaataacatcgttcgtagaaataatcaatcgtgataggggttgcatattgtcaaatgaaagagccacactcggggagcagttcacggacgtcatctcgtgcaacttcggctaatcatataatctaaaaaagttgaggtttgcagttgtcagggcgaaatcaaattcaagtatatagtcctgttcagagccttaattcacgtattcgcgacccttgaaagcgcgtcaagcttatcactcattgactagctcaatgtgtggcaatctaaataagaagtctattgcaaggcaaaaatgctaattattgatagcaaacttagataaggtagaagaattgcacaattcagaaggcgttttttctgctatactcgaatggaatgctttattaaagaaaagcttgatgtcccacgagatgaacgagaacttctatagcatctcacaacctacttaattttgggggatgggtaaaagttagctgaacatacaaataggaataagattgtaccttcaaacgaaactaaacaaatcatagttaatccgcacaaagtttacatattaattcttacggcatatcaaagaggtaatggcttgacttgtgatgaatcatagtttgtgagtaacgacaagatgcggtaaatactgtaatgcgagttttattgactcgacttaaagtttctgatattataataaatacacagtggttaattgtcaattgcttatgcactgctacaccttgtggtcctcggtccagcctgcgtaggatataaatgaagcacgtctcatccagattgttctatcgtacttccaaatacgaattcaacttggcgtctatttccagatatgagccctagaagtgatagacttccaaatctaaaaattaccatgggatatgtttcacgtatccaaaaagtaattataatactgcgtttccattcacttaagtgaggatgttgtctttatactggtttcatagttttgttgtaccaagcatcttttttagttagcactatttccaacctaaaactgttttgtttctcgatgtgagacccttgtcagctgcctgcggtggtgcacgtaaaagccgattagaatattaaatatttacaactccaaatcttaagagccctgctctagtttaaattcatatatcagcataggcttcgcaatttagtgaataagcggtacgaactttcgcggagtacgaaaagtgactaagtaatcgagatacataccgttagattcatgcttcagacagcattctgaatttttgatttataaccatcgaaggaatcaatttcatgttcctaacgtgttaagtcatccgcaaaaaagacgataagagctaccagtgcattttaatttgctgttatattcgttatagttatgatatcattttctatagcctctaccacttaatcctatgaaacttgcgttttaagtattttcactatgtggcggtcttttaggtcagttactatgcgaaaccatactatgttcattgggactacaacgacagaacgcatctataaccttaccagctacctaacttcgttgtggtttactacaactttttaatccaatctattgttctctcttccgcgataagtcacttaatttgttattaaactaattaaatagatatgttgttcgattcctaagtacatacatcacaagttcccgatatcgttaagactactttttaataattccattgtggaatcttattatatgaccggatagcgttatgttggtgaagatggcatattaggctctcaccggtgctattagcttccataccagttggcaacattcattaacatccgctattccttaggaaaaaaatatttaaaagaaatcctgtaacaagtgcatttaatagttctaattaacaacattactcgagcaaactaaaacttttaaacacagaaattaagcagaggctaattatgtgatatgatatgaaattagggtctatatagttataatttgataaattaaattagattaggagtttgcaagataatttagcacagttagttatagacgaaggatttactttcaaaaagcggtttttgttatttgtcttagatttcagcgaaaacaggagtcgttaaaacaaaaaaaatatgtccatcattgcatctaagtaaggcattttcgcaacaggttaacctattttttgtagaaaaactagaggtccacttcaaactctttgatttgtgcagctcgtttatgcatatggcgtgtaaactggtgcgtcggtgtatggagaccttcctttttgtgtatgattggatggactgcgatcacgttttgtaagttctttgggactgttacgcttaattgctcggaatttgagaaaataaacgactattcgtaataacgctttgatcgaactcgaacataacagatcacacatcataatcttcacttttttagtcccaattattgagcagcggagtaaatatatgtctatcggtcactatggatttgcatatgatcgtattactgtagaattaatttaataaatagaatgtataagaaggatctactgtacttatacaaccacgctacatattaacttcaagactatatcctattattgaccttgtgtatacataatatggtttcatacatgtagtgttcaagagttatagcaaatctcatgttaaatgattagggtaacgccttagaattatattctagcctatcggaacacaagcacttttcccgtgtaatccgagtgtcaccacgataatggatggtatggtcgatcgttgttgctattagtacgcgataacttatccttttatcataaattttcttttgaacattgtttacaaaatgtatcaggattaattgatgtaatgagctcgcttgattttggatactagtgtttttatttcgactcggattaatacactatactaaattttaaagccagatatatcaatattaaagtactctatttaacctaatcgttaaacgatctactaaaccgtgtctatctgtatctgcttcctgaatgatactttatcgccaaaatcaacagttactacctaaagtcgctttcgtccttagctacatcgaattctttatacaggtagtaacgtaaatctattccgtagaacgatttttctcttggttataaaacatttctttgatctccaagagaaatatgagatactaaacacgtcgagaatttacgtttgctgctcatttgtccacgcacccatattcctctggaagtaaaaatacatactaatctacctgatgctaatgtaaaatacccaagagacgctgacagtgcgatttaatgagcctttaactgttacattagctgatgaacattattgggtgactagcttgacctcgtattgcccagtgtgtagtattaaaagtgataaaatcaggcttaataagtcgtagcgtcatttacatattgttggccggtgacaggtaaatgtatagtagtataaggtattcttaattgaattatatatcttatacattcatcctagatgacatgaatatactggtacgatgtataattgtactttcgatttaggttaagaactggaacacgtatatataatacttatgcttgtataacctaagttttcaatatcgtttagggtaggatttacaaatccctttccgaaatcataatataagatcggataaccttgtgttcgtggaaagggtacatttgggtcacagaagtggtattacttatgaaagtagctagctataacgaaaatcatgtactactgagcaggaaaattgtatttaaaagatgacttataagtaatgttttacatggtcctaattggttacattactcgggggaactaaaacccatgaccactaaaataaagctgagtttaaatgtgtgatttcatttaaaatttcgatctgtatgtctataatttcgagagatatattggatttgctatttgttagtcgatttggcacacaatgactcagacgaagaacttactatgaaatggcggtatcagttgtcaatgatggatttcagcgaaacaagaaaaccatgtggcttaagaaatacttctctcattgtatttagataaaacatcttgctaaaaaaagatccagtactttgtaaagcaagtagagattcttttaatactctgtagtttgtccagttcttaaaagcaaacgaggagtaatcaggtgcgtgggtaaaagcgaagctacatttttaagtataatcagataaactatgattagtttatatgggatccgtgcgactgtctccgtaatacactcagaaaatgacaatccaatccacaacaagctatgacccactgatggtaatggagcataacgggtctcacagcataaattttaccagtttaatccgagattttcaacattgcggtagacgtgtaacaaccgaccactggccatctacatattattatattccataacttttaacttaatttatacgaaacgcgggtaggatgtactctatttaaatcaccttgctacgtatttagatgtaagcttagttcaatacttgtccttgagcataaatttcaaaaatagcaagtttttggattcagaagttattgcaaaacccaccctatacgtttggggaatggttttagcattatatcctaacctgtttgaacagaagcaccattcccatgttaaccctgcgacttcatcacattgaatactctttccgattaatattgtttttaatttaagatcactccaccttctaacacaaaatttctactgattatttataacaatatgtacgaggattagccaagatgccgagcgcccgtggttttgggtactggagattttatttcgactcaaatctgcgcactaatgtgaattttatagtttgacaagcagataatataggtctctataagacatagaggataattaaatagctaaagcgtatgttactgagtctgtatcttgagtgataccttaggctcttagtccacggttactagcaaggctagttttgtactttcgatacaccggactgcttatgaagagagtaacaaaaatctattttctagagcgactttatcctaggtcatgaaacatttcgttcaactcttagaatattacaaaacttctagtaacctaaaatttttggtttgcacctgattaatctacgcactcgtttttagatcgatgtaaagattgatcaaagtctatttaatactattcaaatataccctacgcatgcggttagacgtattatgaaactctcttactgttaggttagatctagttcgatacttaatgtttgccaatacttcattttgcccacaatgccgaatataaatcggtcttaataaatcctcatagttgtaacgggaactccacattattgagtggtcaccggtaggtgtataattatataaggtattgaaaattgattaaaataaacattgcgcccgttttatataaaacaaactcagacgaacgatgctagaatctgtattcgaaccaagttatgagcgcgaatttctttttaaagtttttgtcgctcaaaaacctgagggtttaacaatgttttacgtgggacatgcgatcccgttgccaatgatgaaatataggtaagaacatatctgtcttcgtcctaagggtgcaattagaaggttgaagaaatgtaacatatatgcaagggaaattaaaagataatctaaattcctgtaaggtagtagattgtgatttaaagatgactaaaaaatattgttgtacatcctcctaatccgttctacgctttacgaccaacaaaaaccaagacctgtaaaaaagagcttaatttagacgcgtaattatacttaagatatctaactgttcgtcttttgtatccagacaaattctgttaccctttttaatctatggatctcatatttaataactcatttatagaactgagtatactatctaaggatcgggggccaacgatccttccaatcagaacatcaaaggtatctggtctgacgatttcttctctcaatgactatagaaaaaaaatcccgctgcattaggatctactactaagtttacctggttgtaaatcttgtaatgtttagaagatcaatggattataaaaactaaacgtggaccctttagtaacgaaagctaaaatctagccacatttctaactagtttgaggtaaattaaaataggtttaattggtatacgtaccctattgtgcataatactttaagtgaaaagctatccaatgttgatcaacctctgaataacaaacgattatgatgtaataggagtgtaatcgcttacatcaaccgagagatttttaggagtatcatcattacccttcggctctaataactcactagtggtcatcgacatgataaaatattcgataatttttaactaattttatttgtatggcggacattatatatttagtatcagtctggttgtaacgatgttagacataagcgtggttcaatactggcgcataaaggataaattcaaaaacagcgagtgttttgtgacccaaatggatagtaagagtaccctgtacgctagcatgacgcatacttctatatagccattcttcaatagacagaaagaagattctctcgttaattttccaatttttttacgttatatatacgttccctttaattacctactagaattaaggacattccattgtgtaacactgaatttttagtgatttattatatcaacatgtagaccgattaggcaagacccgaaatgttggttgtcattgcttctggataatttttctggaactatacctgcgcgttgatatcaattcaatgaatcttcaggcagaaaagttaagtcggtttaagtgaatggaaaaagttagaaacctagagtattaattatcgagcaaatatcttctcatatatgatagattcccacctcccggttcttaggaaggttaatgatgtagtttctatagacctgactgcaaaagagaagagttcctgatatcttttttttagggtaacgtaatcctaaatggtgtttctaatggaccaacatttaaaacgtcacaattcttgtagttacctagtatttttattttgcacgtaggaaatcattgttttagattctagatctgtttaaaggttgatcagacttgaatctaatttctccaaattatccatgtgctagagacagcatatataatgaaattcactttacaaaaggtcacaactagttagggacttattgtttgctaatattactttaatctgacatttgcaattgttgctggctctctaataatcgtcgtagtatcaatggagagccgagatcatagagtgtttaccagcagctaaactatctaacgagctattaaagatacatgaaagtaaacataccgcctgaaatatttaaatcatagtcagaccaaatttgctacaactcgtattcacacgaacttttgacggtgtatttcccatttaagcttttgttgctcacaaaacacttggtatacgtattaatctcatgagacatgcgatcgtactgtgtacggaggtgtttcgataaaaagttatgtcatatttatctaagtaagcggataaaaagataaatatacgcaatataaatgcaacagaaattaatggacggtcttaatttctgtaaggtaacacatcctgacccaaaagtcataaagtaatatatttgaacttctggtcaaaccgatcagggctgttcaaccaacacttacgggggcttattaagaagattttgttacggacccacaactgtcgttaggtaactttgaagtccgtcttttcggatcggccaaattgactcacctttttgaatcttcgcaagacataactaatagctcctttataaaagagtaaacactgtctaaaggtggaggcccaagaatctttccaatttccacattaatgataactgcactcacgtcacctcttctttagaacaaaagtaaaaaactgccattgcactaggacttaccgcaaatattacctcattatataaattgcagccttaagaacatcaatagatcataaaaataaaacatatatcctctattattaaaatgtaagttcttaacaaagtacgaattagtcagaacttacattaaagagatttagtaggtacacggtttctgtcgtataaattagtttatttcaaatgttttccagtattaatcaatgcctcaatagcatacaattataatgagactagactataaacgttagcgacgacagagaggttgtaagcggcattatagttatctctccgctctagtatgatacaaaaggttgccgttcagatagattggtcaataatctccctgaactatcgtctgtatggcggactttataaatgtagaatcactctaatttaaatgatggtcagcatttgtgtgctaaaaaaccgtcaaataaagcgtatattcgaaaacaacgaatgtcctgtgaaccatatgcattactagagtactccgcagacaagtatgacataaggctccgcaaggctatttatcgatactatataaatagatataatcagctatttttctgtttatatccgtaatttttacgttgtttataattacttgccagagtttatcactttccatagcgaggaagccggtatagagtttttcggtatataagcttaatgactacttcgggtagtcccgacaagatagatctgaataccctcgaataaaactccaaaaacaatggctggctgttggcagcactgcattgaaacttcaggcacaaaggcctagctgacttaaccaagtggaaaaacttagaagcatcctaatatgattatcaacgaaaaacattttcatttgtgagggatatccaccaccagatactcaaaaacgtaataggaataataactattaagatgagtacagtggagatgatatcatgtttaaataatatggtggtaacgtgatctagaatgccccttatgagagagtaatgtatttaacctcggagtccctgtacttatctactatttatatttcaaatacaggagttaacattttaacattcaagaattgtttcatgcataatcagtcttgaatgtaattactgtaatccataaatgtgtcaaagacactatatctaatcaagtaaagtttagaaaaacgcataatcaattacggagttatctcatcttaatattattgtgatataatatttgcaatcgctgctgtctctccaactttcgccgtaagatcattagacaggcaagctcttgttatattttacaagggcatgtctaactatccaatcataagagggattcgacagcagaggtactgcctgaaatatcatcatgttagcgaaattaaattatgtaccagtcgtaaaaacacggttttttagcagtttattttgcgtataggcttacgttacttacacgatacctggtattcgtaatgatcttatcaagcgtctgttgaaacagtattccgaggcgctgcgttaaattgctatgatatagttatttttattagtcgataaaaagacaattatagcgattaagaatgcaactaattataacgaacggcctcaaatagtagaaaatatccctcctccgggcatctcctaaaatgccatatattcggattattgaagatggttaccacggcagttttatctagtctcataggtctttatttcgaggttattcttaccgactgtgatgcgtcgtgtcccagctttgaatgcgatatcaccggattgtctgacttggttcaccttttagattcctcattgggttatactaactgacacttattctttaagtaaggactccttattggcagtggtgaatgagatttggcattatccttattattgataattttactcctgtcgcatgaattacagtacgagcttattttaccaggataccacttgatcttatggaggatactctttcaattcttgaattggacccacagagatgagtgtactagatgaacgtacacattatgtgctcagttgtataattgtgtgttttcaagaaagaaggtatacgtcaatacattcagtatcgacataaggtatttggatagtttcagtgatatagaccaatagatttcagatctctttacgtatcagtaaatacctttatagagttgattcatattaacactattttacatacatcaccgacgacaaaagggttgaaagtggcactctactaatttgttcatgtgtgaacaataaataatattcgagtacacattgatgggatagtgttctcgctaggctgtccacttcgtaattatcctttgagtagtgcagacgcattaatttaatatgtggtcagcattttagcgtgaaatgatggtcaaattgtacgcataccacgttgggatgtatgtgctatggacttttagcattacctgaatcattgcctatcgattttgccataaggcttcgccacgtaattaagtgattccatacctacaagagtaatgtgccgaatctatgttaatatcaccgttccttgtgttaatcaataatggtagccgctgcttatcatcaaataaaggaaggacacccgaggaggactttacggtgaatatgccgtataacttcggctaatcatgttatctaaataagttggagtttccagatataagggccgaataagaatcgactatacagcgcagttcagggccctaactcacgtaattgtggcctaacagaccgaatcaagttgaaaacctatggagtagcccaatatgattgactgtgaataagaaatttattccaagggaataaccctgatcattgactctaaactttaataggaataaagattagtacaattgagaaagcgtacttattgtcatgctcgaatgaaatgctctattagagaataagttcacgtcctatgagaaggttaagaacttttcctgcatctctcaacttacataatctacccgcatgcgtaatagacgagtgaacatataaatacacaaaagttccttccttcatacgtagttaagcaagtcatagctgtattccataaacctttcaaaatcactgtatcaggttatctaagaactagagaaatggctagtcatttatggtaatatctcagttaagtctaaatgcgataaattgtgtattgcggctcctattttcccgactttaactgtcagatgttataacaagtacacagtagttaattgttatttgcttatgtgcaactacgctatcacgagaccgatccggcaggtgaagcatataaaagaaactcatcacatctacataattatatcgtacatcggtctaagaatcgtactttgcttctaattttacatgcgtacggtgcaactgtatatacacgaaatctaaaaatcacaatggactttgtatcaggtatctaaaaggaaattctgatgccgtgctttaattcactaaagtgtggatgttctctttatacggctttgatactattattgtggcaagcaacttaattagttattaccatcgccaacgtataatagtttacttcctcggtgtgggcccctcctcaaatgccagctatagagcatgttgaagccgattagtacaatagattttttcaaccccaaacgtcaacagtcccgctttagtctaagctgatatgtcgggtcaagtctcgggattgagtgcattagcactggaatctctcgctcagttcaattaatggataactcatcgagttatactccgtcacacttattctttaaataacgttccgttattaggattaataactatcgtttgaaactattccaatttcttatcgtgttaagtctttcgcaagaaagacagtatgagcttactttacgaaataatttctttttcaactgcaggatactctactaattcttgaagaagacgtagagtgttggatgaattagaagcccctacccattttctatcgacttgtatatttatctctattcaaagatggaagtttgcatcaatttgttcagtatcgatatagggtgtttcgaaagtattagtgacatagccctatagattcttcattaccaaaccgaacactagttagtattaaacagtcaattctgttctacgccatttaacacataacgctcaagataacagagctgaatttgagagactacaatattgtttatgtgtcaccaattaacagttaacgaatacatgacgatgcggaacacctcgggccaggccgcgcacttcctatatttactttgagcagtgtaggtgtaataatatagcatgtagcctcatgcttaacttgaaccggagataaaaatctatgcacgcgaccttcacatttacaaggtttagatttttaatgctacccaaaacaaagtccataggtttttcattaagactacggcgcaaagttaagtgatttcactcctacaacagaaatatgcccaaactatgaaaacaacatggttcgtagaaataatcaatcgtgatagaggttgcatattgtcaaatcaaagagccacactcggggagcagttgacggacgtcatcacgtgcaatttcggctaatcttataatctataaatgttgaggtttgcagttgtcagggcgagatcaaattcaagtatatagtcctgtccagagccttaattcacatattcgcgacgcttgaaagcgcgtcatgcttatcactgattcactagctcaatgtgtggcaatctaagtaggaagtctgttgcaaggctaaaaaactaaatattgatagctaccttagttaaggtagaagaattgcacaattcagtaggcgttttttctgctatactcgaacggaatgctttattaaagtaaagcttgatgtcccacgagatgaacgagaacttctataacatctcacaacctactaaattttgggggatgggtaaaagttagctgaacatacaaataggaatttgattgtacccttagacgaaactaaacaaatcatagtaaatccgcacaaagtttacatattaattcatacggcgtttcaaagaggcaatggcttgacttgtggtgaattacagtttgtgagtaaccacaagatgcggtaaatactgtaatccgagtttaattgactcgacttaaagattctgatattataatgaaaacacaatggtttattgtcaattacttatgcactgttacatcttgtggtcctcggtccagcctgcgtaggatataaatgaagcacgtctcatccagattgatctatcgtacctccaaatacgaattcaacttggcgtctatatccagaaatgagccctagaagtgatagacttccaaatctttaaactaccatgggatatgtttcacgtatccaaaaagtaattataattctgcgtttccattcacttaagtgaggatgtagcctttatattggtttcatagttttgttataccaagcatgtattttacctagcactattttcaacctaaaactgttttgtttctcgatgtcaaacccttgtcagctacctgcggtggtgcacgaaaaaaccgattagaatattaaatatttacaactccaaattttaagagccctgctctagtttaaattcatatatcagtataggcttcgcaatttagtgaataagcggtatgaattttcgcggagtatgaaaagtgactaagtaatcgagatacataccgttagatagatgcttcagactgcattctgaatttttgatttataaccatcgaaggaatcaatttcatgttcctaacgtgttaagtcatcagtaaaaaagaccataagggctccccttttgaaataatactgtttcaaactataggctgccctacttggtgttcaagatactatagagtcttcgatgatttaaagcccccaacccatgttcaatcaacttctatgtttaaccttaaactaacacaggaaccagctaagatttgtttagcatcatttgggcacgttacatatataaaataaagtatgccgcagagtttctcccttaccgaactgtagtcgacctaaagtctaatactcattggtgttgtatcacttttgtgacattaggtatgatttaactcttgaaaatttttacgactatgataaaagattagagctaccaaataactgttaataatcatgtcactatgtagatcgccaagaatcagctgggatgaatgcattatttacatcgtgcaaactaggtctgagtaggtaccatcgtagtttatgcctaagttgaaccgcaaatataggtcttttgccgggatctccactatctgtaaattgtgaaacctgttggtaacctatacaaaatacatagctatatcattagtaataaaacgtaaacgaaagatcattcactccttcttcggaaagataaccaaagaattaggagaatatggtgcgcacatagaaaggatcgggaaataactttgaccttcacagaacaataagttacaatttgggaacagtcggataacgccactacgtgcttatttggtttaccttaaattttataattgatgaggattaaaattcacgggagaagatctaacataagtatatagttatatctgaagcgtttgaacacttactccctttacttaattaggccttattgttttccctgactcataagttctatgattggcaatctatctacaaggagacacgtatcatttaaaaacaaaaaattggtaacttccttagttaaagtgctgggaatgctcaaatcagtagtcttcttctctggaaatcgcgaggggggaattttatcatgtcgaagtttgttattggactcattcaaccataggctccatgatattaaaagagctagtaaactacgggggtaggatacaaatttcttgataatagaaatcggaattcgaatgtgtccttggtcgactcagatccaatccaagtgaacccaacgaatgtatatattttattacatatggcgtcttaaacagggaatcccttaacatcaactggttttcagataataagtaaccgcaacatagtgaaaacacagttatcgatactagttagagaacctttaataatgctacaaccattttctaatcttgatgatttgttgacaattattagttcagcgagccatctaacggttcttagtcaactctacttatgcaataaatcttgcatgtttgacgctaactcaaccatggtagcatcaaatacggatacaattaggggttaatatgcagaaaatgggcttagggatgatagacactttacaaattgcacaagcaatcgaaatgttttatgtatcgatatagtatgcatttttatagaattgccttctagcatgacagaaacaagcctatctattcgtttctttatcctcctataccacgtgtgtacctttcccggccattcattaagaccggaagtatcttgttatacaatattaaacctttaacagcctatcgcgctgatacacgaattaaccaaatgaagtttaaaaaattaactactgttatttttaagtggcttcttcaagattgcattcatatatcaataatgacttactaaggttctaaatgagagaattcaattaatctggataaacaaaagggtctgaagattcataataccaaccattaaatagacgttcctctgtgtatagtaaatctttattttttaacctttgaagaaatcgacaacacgacccttgcgagtatagttatgaaaagaagagatcttcatctttgcccccttataatagtacagcttcaaacaatattctcagtaagatggtatgtgtggtactaagactttcatgactatttgatgtccttattctatgtataaagagtaataatcttaagtctggagtttactcagcaaccagttgagtctaggcacagctttcttgggttgcttatatattgaaaataatgtactcaacaggatcagtctcataaggaattgtgattgaccaaaagtccgctatgcattgacgtcgtctcagtttagtacctataactatcatcattcttttggtggctattacaatgttggtaaaagaataaaactacaacacatctgttaataatcaactcgctcgattgattgtcaagaatgtttagtgatgagtatgttatttaaggcactcgagttgtgattgagttggatccattgtagtttacggctatataagtcctcaataatacgctctatacgcaaattcctattatctgtgaaatgtttaacgcgtacgctaactctataaaatacttaactatattatacgttagaatatcttaacggacaatcgcattgtatttatttgtatagattaatgaaaaagtaggtgcgaatattgtaggtatggtaaaggccggtaagtaattctagccttcatggaacgttatgttttaatttgaaatttaagggatagtgcgtctaaatcgttaataaaattagttgaaatcacctagttagaatctgtaaaaattcaccataaaagttccaccgtaaattaatgattactactgtataattccaaaatttactctcttaagttaattaaaccaatctgtttccctaggcttctataaaatagcgtcggtaattttcccgcatggagacagatgttattcggaaataaaaatttacaaacttctttggcacttctgctgacaacagttttgtttatactattcttgtcatgatgtagatacgacgcgttattatcatgtcgaagttcataataagtgtcattttaccatacagaccatgattctgaaagtactgacaagctgcaaatatgaaattcatatttctcatcacaaggctacagacctctaataagatgtacgttaactgagattcgtgtcggtagaaccgaacgatcatgtaactttcactatatgagttgacctgctttgagctttcctttatactaactggtattctggcgaaacaaagctgtagcagaatcatgtcatgagtattaatagtagtaagaaaatcacggataatgttacaaccgttttcttatttagaggtagtgtgaagaacttttacatgaaccagcaaactaacatctctttcaaattactactcatacaataagttccgtgacgacatgactatctcaacctgatttacaattaatgctcttatattgagaagttattaagcgagatatgcatttaaggataatagacacatcacaaattgcggataccattgagacattttataaatagatgcaatatggaatcttatagaattgcctgatagcgttatattgatgaacatgactaattaccctttcacccacgctattagcttccataccatttgcggccattcattaagatccgttgttccttacaaaaaaaaaattaataagaaattccgtaacatgcagatttagtagttattataaacaactttactggaacaaactaaaacatttataaacagaattttgatagtggcaattaatttctaatgatgtgatattaaggtctaaaatgtaagaattcgataaattagattagacaaggggatccgaagatattttagcgcagttagttatagggggaacctctgcctacaaaaagcgtttattgttaattgtttaaagatacagtgaaaacgacagtcgttaaaacaaaaatgatatgtacaatactacatctaagcagcgcaataacgcaacagcttgaagtatttttcacagaaaaatcgtacgtccagttctaacactttcatatgtgttcgtcgtttatgcttttagtatgaaaactagtgtgccggtgtctggagatcatccttcttgcatatgactccaaggacagccatcatggtttgtaagttcattgagactgttacgcttaactggacgaaactcgagaagatatatgattgatcgtaagaccgctttgattcgacaccatcataacacagtactcatgattatcatcatttttttagtccctattacaaagctgccaagtgaataaatctctatcacactctatgaaaatgcacttgatcgttttattgtagaaaaaatttaataaacagaatgttaatgaaggcactactgtactaatagagttgggctatatgttaactacaagactataacttattaataactcggtctatacataatttggtatcatgtatgtagtgttcaagggctatagcaattctgataaaaatttattaaggtaacaccttagaataatatactggtctatcgcaatacaaccacttctaccgtataatccgagagtggccacgataatcgaaggtatggtcaaccgttgtaagtaattctaggcgataaggaatcctttttttataaattttctttaggacattgttcacgtaaattatcaagattaattgttgtaatgagctcgtttgattttgaaaatttgtgtcttaaattcgtctccgattaatacactatactatactttaatcccagatatatcaatattaaactatttaatttaatctaatcctcaaaccttctattaaatcgtgtcaatcaatatctgcttcctaaatggaagtttttcgccaaaaacaataaacagaatttaaagtcgcttttgtcctcagcaattttgttttttttatacaggttataacgtagattcattccgttaaagcgttgtccaattggataaaaaacatctttttaatctccaggtcaagtttgtgaaagtaaacacgtcgagcaaatacgtataccgcacatttgaccacgcagccacatacctctggaaggaaaaacacatactaacctacctgacgctagtgcaaaacattcaagaaactctgacaatgcgaattaacgagccttaaactcttttatttgctgataagcattattgcgaaactagcttgagcttgtattgtctggtgtgtactattagaagtgaaaaaatcagggttaatgtctcgtcgcctcatttatatacagatagtcagtgatacctaaacgtatactagcaaaatgacatcttaattaaattatttatcttacatattcttcctagatgacatgaatatgttggtccgatgtataattgatgttctgatataggataataactgaaacacatatgtattataccaaagtatgtacatcacaagttcccaatatcgtttagactactatttactaatcccattgtggaatcttaatatatgatcggatagccttgtgttcgtgaaaacggcatattaggctcacagcggtgctattaccttccataccagctagcaacaacgataatcatccgctattggataggaaaatagtatttaaaagaaatcttgtaacaaatgttttatatagtcctaattaactacattactcgagcgaactaaaacttatgatcacaaaaataaagctgagcctaattatgtgatatgatttaaaatttcggtctatatagttataatttgatgaaataaattggattagcagtttgctagatgatttggcacagatagtcatagacgaaggacttactatgaaatagcggttttagttgtcaatgttggatttcagcgaaagcaggaatcgatgtagctaaagaaatatgtccatcattgcatttagataaggcatcttgccaaaaagagaaccaatattttgtaaagaaactagaggtcctctttatactctatgatttgtgcagctcttaaatgcaaacgacgagtaaacaggtgcgtgggtgtatggagaccttcatttttatgtatgattggatggactacgatcacattttatgggttctctgcgactgtcacgctaaattactcggaaattgacaatgtaatcgactacttgtaataacccactgatcgaactggagcataacgggtcacacatcataattttcactattttagtccgaattattcagcatcgcagtaaatgtataacaatcggccactgtccatttacatatcatcgtattccattagaattaatttaatatatagaatgtgtaagtaggatctactgtacttatatgaccatgctacatattaacatgaaaactatatccaattcttgaccttgtgtatatataatatgaatacgaacatgttggattcaaaagttatagcaaatcccatcttaaatgtttagggaaaggctttagtattatattctagcctattggaacacaagcacctttcccatgtaaacccagtgtcttcaccataatgaatactttcatcgatcgttattgcttttagtacatgatgactcgtccttttaacataaattttctactgaatattcattacaaaatgtaccaggattaaccaatgtaatgagcccccttgattttgggtactggtgattttatttcgactcagatttacacactaaagtaaattttaaagctagacatacaaatattaaagctctctatttaacctaaacgataaacaatcagctaaaccgtgtcttactgagtctgcttcttgaatgatactttaccgccaaagtcaacagttactacctaaagtcgctttgatcttttgctacaccgaattctttatgaagagagtaacgtaaatctattttgtagaacgatttttttctaggtcatgaaacatttcgttcatctctaagaaaattatgagacattaaacaggtcaagaattttcgtttgctcctcattagtccacgcacccattttcgtttcgatgtaaaaattcatattagtctatctgatgctaatctaatataccctagacacgctgacagagccattatgtgagccttttactgttaggttaggtgttgttcgatactgggtgactagcattacctcgtattgcccagagtgtggtatttaaaatggtcaaattaggctctaaaagttgtaacgccatctgcacattgttggctggtgaccggtagatgtataataatataaggtattcaaaattgaattaaatatgctttgcgctcatcctacatgagataaatatagtggaacgatgcataattctacattcgattcaggttatgaacaggaactcgtatttaaagtttttatcgttcaaaaacctaagtcttcaataacgttttgggtgggatttgcaaaccccttaccaaaatcgtaatataggattggataaacttgtcttcgtggtaagggtacaattgggacgctgaagtagtgtaacttatgagaaaggctaattataacaaaaattaaattctagtgaggtggaagattgtattttaaagatgactaataaatattgttatacatgctcctaatcggttctacggctcgcgggcaccaaaacccatgacctctaaaataaagctgagtttagacgcgtgatttcatttaaaatttcaatctgtttgtctattatatccagagatatactgcatctcctattagtttatcgatttcgcatacaatgactcagacaaagaactcactatggaatccgagaatcaggtgccaatgatcgttccgatcaaaacatgaaagctatgtggcctgacgaatacttctctcattgtttttagataaaagatcttgctgaaataggatccagtactttgtaaagcaagttgagaatcttataatgttttgaagatcatcgggttctaaaaaccaaacgtggactaattaggtgcgtgggtaaaaatctagctacatttctaagtagtttcagataaattatgataagtttatatgggatgcgtacgccagtctgcataatactttgagagaatgacaatccaatctagatcaagctatgaattacaaacggttatgaagtaaaacgggtgttacagcttaaatttagccagaataatttaggagtttcaacattgccgtagaggtgtaacaactcaccagtggccatccacatattaatatattccataacttttaactaattttatttgtaacgcgggcaaaatatattttgtttaagtctgcttgctacgatcttagacataagcttggttcaatactcgcgcttaaagaaaaatttcaaaaacagcaagtttttggactctcaaattgttacaaaatgcaccctgtacgttaggggaatggttactactttatatccattcttgtttagacagaagcacgattcccatgttaatcctccaacttcattacattgaatatacgttccctttaattttctatttgatttaaggtcattccatcatctaacactaaatttctactgattatttataacaatatgtaggaggattaggcaagatgcgaaatgctggttgtttttggttctggacattttatctcgaattaaatctgcgcattaatatgaattctatagattgacaagcagaaaacataggtctctttaagacaatgggaataattaaatacctagagcataaattactgagtaaatatcttgactcatatcatagattcctagcccccggttgctaggaaggttagtcttgtagtttccatagaccagactgctaaagaagagagttactgatatcttttttttagggcgacgtaatcctagatgatgattcatatggaccaacacttagaatattacaaatcttctagttacctaatatttttgatttgcacctgggaaatcattgcattcgattttagatcggtgtaaagattgatcaaactccatttaattttatccaaatttaccatatgcatgggataacacgtattatgaaattcacttttcgttaggttacaactagttcgagacttattgtttgctaatactacattatcctcacattagcgaatgtaattggctctctaaaaatcctcatagttgtaatgggaagccgagattattgagtgatcaccagtagctgtactattttataagctattaaaaattgattaaaataaacataccgcctgtaatatataaatcatagtcagacgaacattgctacaatctgtattcgtaccaagttatgagcgcgtatttcttatttaagtttttgtcgctcacaaaacactgggtttaccaatcattcacatgggacatgcgatcgtactgcctatgatgatatattggtaagaagttatctgtctttcttctaagagagcaattaaaaggttaaagaaatgcaatatatatgcaagggaaattaatggataatcttaattcctgtaaggtagcacattgtgacttaaaaatgactaaataatattgttgtacatctagctaatccgttctgggctttacgaccaacagtaacgaagacctattaaaaagaccttgatatggacgcgcaactatagttaagttacctagatgtccgtcttttctattcagccaaattctcttacctttttcaatctttggatctcataattaatagctcgtttatagaagagtatatactatctaagggtggagggccaaggatccttccaatcacaacatcaaagatatctggactgacgttttctcctctcaaggactatagaaaaaaaatcccattgcattaggatctaccacaaagattacctggttgtaaattttgcaatgttaagaacatcaatggatcataaaaataaaacgtgcatcctttagtaacaaaatctaagatctagacaaatttccaactagtctgaacttagattaaagaggtttaataggtacacgaactctgtcgtatatattactttaagtgaaatgttttccagtgttgatcaatctctgaataacaaacgattataatgaaattagagtgtaaacgttaacaacgaccgagagatttttagcagcatcatagttacctctcggctctagtatctcacaaatggtcatcgatttgataaattgctcgataatttctatgtactttcatttgtatggcggactttataaatttagtatcagtctggtttaaacgatgttgagcataagtgtgcttgaaaactgccacataaagggtaaattcgaaaacaacgagtgttttgtgaaccatatgcataattagagtaccctgtacgctagcatgacacatgcctccacaaagctattcttcaatacagtataaatagattcattcgtctatttttctatttatatgcgttatatttacgttgtctttaattacctgctagaattaaagacattccattgtgtaggactgagttttcagtaattcattatattaacttgaagaccaattaggcaagacccgacaagttggttgtgaatgcctccgaataattcttctaaaactatgcctgggtgttgacagcaatccattgaaacttcaggcagaaaagcttagccggtttaagtgaatggaaaaacttagaagcgttctgtattgattatcgaggaaatattttctcatttgtgacagatttccacctcccggttcttaggaaggttaaaggtgtaattactattgacgtgactgcagaggagaagagatcttgttttcattttttaacggtaacgtgatcctgaatggcgtttataatggagcaatatatttaacgtcggaattcttgtagttatctagtatttttattttgtatataggagataataattttacattcaagatttgtttcatgcttaatcagtcttgaatgtaatttctctaaatcatccatgtgccagagacagcatatttaatgaaataaactttacaaaaggtcataattagttagggagttatcgtatgttaatattactctgatctgatatttgcaatcgctgctgtctctccaatattcgccgtaatatcaatagagaggcgagatcatactgtgttttccaacggcaagtctatctaaccagttattagaggaacttgatagcagacataccgcctgaaatatttacatcttagtcagattaaatttactacgactcgtaaacacacgattttttggcagtgtatttcgcatataagcttttgttgcttacaggacacttggtatacgtaatgatctcatgagacatctgttcatactgtgtaccgaggtgttccgataaatagctatgttatatttatctatataagccgataaaaagacaaatataggcattaaaaatgcaacaaatattaatgaacggtctcaattagtgaaaggtatcgctccttggcccatatctcaaaaagcgatatattcgaactactgatgaagcccatcagggctgttctatctagacttacgggagcttattttgaggtttttgttacggaccgacaaccgtcgtgacgtaactttgaagtccgtctttccggatcgaccgaattggttcacctttttgaatcttcgtaggattatactaatagttgctttttgtaaaagtaaacactccctataggtggtggtctatgagtttttccattatccttattattgataattctactcatgtcacctctactatagtacaaatttattatactaccattgcactagatcttacggcgaatactctctcattacataaattggagcctcagggacatcaatagatgataaatataaagtttatgtcctcaattgtaaaattgtaagttcttaacaaagtacgtattagtcagaacttacattaatgacattaggtatttacacagtttctgtgatatagattagttcatttcaaatctttttccgtattagttaatgcctcaatagaatagaattataataacactatattataaacgttagcgacgacagagaggttgaaagcggcattctagtaatctgtccgttcgagaacgatataaaatgttcccgtacagattgataggttagtattctccctgagctgtcgtctccatgacggactttatagtagtacaatcgctttaatttaatacatggtcagcatttctgtgccaaaaaatcgtcaaataaagcgtatatccgaatacaatgaatgtgctatggaccataagcattactagaatactccgcagacaactatgtcataaggctccgcgacgcaatttaacgatactatatcaataaaaataatcagctatttttctgtttatatcgctaattcttacgttgattaatattgcttgccggagtttatcatcttttatagggaggaggcccgtagaggattttacggtatataagcctaataacttctaccaatggtgccgtcaaaatagatcagagtatccagaaataaaactccaataagaatggctgacactaggcagcacaggatcgaaacttacgctacaaaggcctaacagactgaaccaagtggaaaaactaagaagtatcccaatatgattaactgtgaataagatattcattcgtgaggaatatccgtcaccacttactcaaaaccgtaataggaataataactattaaaatgaggacagcgtacataatgtcatgctcgaataatatggtcgtatggtgaactagaatacctcctatgagaaagttaagaacttaacctgggtgtctctgttcatatcttctatttgcatctgtaatacaggagtcaacatattaacacacaagagttctttcttccatatgcagttatgtaagtcattgctgtattccataaacctgtcaaagtcactatatctggttatgtaaagtctagagaaatgcatagtcatttatggaaatatctcaactaagtataattgtgataaaatgtatgtagtggctgctgtttttccaactttcaccgtgagatgattaaacaagtacactcttgttatttattataagctcatgtgtaactaccctatcacaagagcgatccgacaggtgaagcattaacaggaaactcatcacgtcagcgtaattaaattatacaccagtcgtaaaatcgcactttattagcagtttaacatgcgtatagtctaaccctacatacacgatacctgaaaatcgtaatgaacttagtaacggatagttaaaacggtattccgaagcggtgcattaattcgctaaggtatggttgttcttattacacggcttagatacaattatagtggcaaggaatacaattagttattaccaacggcgacgaatagtagtttatttccttcctgcgggctcctcctgaaatgccacttatacggcttattgaagccgattagtacaatagatttattcaacctcaaaggtctatattcccggcttattcttagctgatatgtcgcgtcgagtcccgggtttgagtgcgttaacaccggattgtctggcttagttcaacttttggatacctcatcgggttatactaactgacacttattctttaaataaggttcccttattgggactagtaactgagatttgaaattatccttatttctaatgatcttaactctttcgcatgaataacagtacgagcttactttacgaggttatcacttattcaagtgcaggatactcttccaattcttgaaaaggacgtagagagttgaatgtattagatgggcgtacgcattatgtgctcacttgtataattgtgtgttttcaaggaaggaagtatgcatcaattcgttcagtatcgacataaggtatttggaaagttttagtgacatagtccaatagatttttgatctctttaccgatcagtaaataccattatagagtcaattcagatttacgctatttaacacacaacgccgaggataaaagggctgaaattgacagtctacaatattgttcatgtgtcaacaattaacaataaacgaatacacgttgatgcgatagtgctctggctaggccgtccacttcgtatattttctttgagtagtgtagacgtattaatatagcatgtagccagattcttagcatgaaacgatgattaaaatgtacgcataccacgttgagatgtatgtgctatagacttttagtgttacctgaaacatagtccatcgattttgccataagactacggcacgaaattaagtgatttcacacctacaagagaaatgtgccgaatctatgataataacaccgttcgttgaattaatcaataatggtagcggttgcatattatcaaatgaaggagccacacccggggaggagtttacggtcgatatcccgtacaacttcggctaatcatgttatctaaataagttggggtttgcagttgtcagggcgaaatcagattcgactatacagcccagttcagagccctaactcacgtaatcgtgaccttacagagcgagtcaagttaattacctatcgagtagctcaatatgagagagtgtgaataagaaatttattgcaaggcaataatcctaattattgatagcaaactttgataagaataaagaatagcacaattcagaaagcgtacttactgtcatactcgaatgaaatgctttattaaagaaaaagttgacgtcctatgagaagattaagaacttctcctgcatctcacaacctacttaatcttcggggatgggtaatagataggtgaacatataaatagagataagtttctaccttcaaacgtagttaaacaagtcatagctatatcccacaaacctttcataatcactgtatcgggatatctaagaagtaatggtatggctagtgatcaatcataatttgtcagttaagacaagatgcggtaaattgtgtattgcgagtcctattgtctcgacttaaactgtctgatgttataacaaatacacagtagttaattgtcaattgcttatgtactgctacgccttgtggagaccggtccggcgcgtgaaggatataaatgaaactcgtcacatccacattattatatcgtacatcggagtacgaatcgaacttggcctctatttttagatgcgtgcgctgcaagtgtaaatgtaccaaatctaaaaattacgatgggttttgtttcaggtatccaaaaagtaattctgatgccgcgcttcaattcactaaagtgaggatgttgtctttatacgggtttgatacttttattgtaccaagcatctttattagttagcactatccccaacgtataacagtttactttctcggtgtgagcccctcgtcaactgcctgcagtagtgcacgttgaagccgattagaatattagattttttcaactccaaacgtcaacagtcccgctctagtttaagttcatatatcaggacaggtctcggaattaagtgtataagcgctgggaactttcgcgcagttcgaatagtgagtaagtgatcgagttacacaccgttagattcatccttcagataacgttccgtttttttgatttataactatcgtttgaatcaattccatcttcttaacgtgttaagtcatccgcaaaaaagacgatatgagcttaccttacgaaataatttcatttcgaactacagggtgctctacttgctcttgaagatatcgtagagtgttggatgaattaaaaccccctacccattttcaatcgacttgtatgtttatccttaaactaacatggaaatttgctttgatttgtttagtatcatttaggcgtgtttcaaatgtataattaagtatgccgcatagtttctccattaccgaactgaacaccacttagtgtcaaacactcattgctgttctacgccatttatgacattacgctcaaattaactgagctgaatttcaaagactataatattatttttgtgttaccaattaacagttaacgaatacgtgacgatgtagaacaccaggagccaggtcggacgcatcctatatttacttcgtgcagagtaggtctaacaagatagcatggaggtttatgcttaagttgaaccgcagataaaggtctatactcgggatcttcactatctgaaggtttagaattttaatggtaccctatacaaagtgcataggtttttcattaatattaagacgcaaaggtaagtgaattcactcctacaacggaaatatgaccaaagtatcaaaacaatatggttcgtagaaaaaatcgatcgtgataaaggttggattttgacaaaacaaagagctacagtctgggaacagtcgatggacgccaccacgtgctttttcggctaatcttataatttataaatgttgaggtttagaattctcgggacgagatcaaatttaagtatatagtcatatccgaagcgttaaatcacttattcgccatgcttaaaagcgcctcatgcttttcactgattcattagctctatgtatggcaatctatgtacgaagtctgtcgtaagacttaaaaactaaatattggtagcttccttagttaaagtacaaggattgcacaattcagtagacattttttctggtattcccgaacggaaagctttattaagacaaagtttgatatccgacgggatgaaccacaagttctatgatatctcagaagctactaaatttcgggggttgggtacaagttagttgaacatacaaattggaatttgattgtatccttggtcgattctaaacaaatcgtagtaaacccgtgcaaagtatatatattatttcatacggcgtttcaaagaggcaatggcttgacatgagctggatttcagattatgagtaaccacaagatagtgtaaacactgtaatccatatttaattgagatctcttaaaaatgctgatattattttctaaactcgatggtttattgacaattatttgtacagtgatacatctagcggttcttggtcgaccctacttacgtaataaatgtagcacgtttgatccagactcatccatggtagcttcaaatacggattcaacttggcgtttatatccagaaaacggccctagaggtgatagacatttaacactttggacaaccattggatatgtttcacgtatcgatatagtaattattattctgcatttgctttctagtaagtgaggaagaagcctttctattggtttcttaatcctcttataccacgcgtgtatctttcctagccctttattgaaactggaagtgtcttgttattcaatgttaaacccttgtcagcctattgcggtgatgcacgaaaaaaccaaatggaatataaaatattaactactcctaattttaagtgccctcttctagattgtattcatatatcaatatagacttcgcaaactagtgaatgagggaaatgaatttatccggaataacaaaagggactgagtattcaagatacaaaccgttagatagatgttccagtctgcatagtaaatttttgttttttaaccattgaaggaatcaatttcacgatccttacgagtttagtcatcagaaaaagagacctttagcgctccccccttgaaatagtacagcttcaaacaataacctgagtaagttggtatccgaggtactataaatttttcgatcatttgatgcccccatcctatgtttaaagaactattatctttagccttaagcttacacaggaaccagctgagtctaggttaggttcacttgggttgcttacatatataaaataatgtataccgcagaatttgtcccttagggaattgtagttgaccaaaagtctattactcattggcgttgtatcacttttgtgtcaataggtatgatcaatctcttggaaattattacgatgttggtaaaagattagaactactaaacaactgttaataatcaagtcgctccgtagattgccaagaatcagttgagatgaatacgttatttagaacgtacaaactacgattgagttggtaccatcgtagtttatgcctatgttaatccccaattatacgtcttttgcccgaatccccactatctgtgaaatgtttaacgtgttcgttacctttacaaaatacatagctatatcatacgtaaaaatatcttaacggaagatcgtacactctttcttcggatagataagcaaagaaataggaggatatggtgcacacatggaaagggccggtaagtaattctggccttcatagaacaatatgttataatttggaaattgtcggatagcgcgactatgtgcttaattggtttactttaaattttataattgatgacaataaaaattcaccggagaagttctaacgtaagtatatagttataactgaacgattccaagatttactcccttaagttaattagacctatttgttttccctgactcctaagttttatggttggcaatttatctgcaaggagacacatatcatttagaaataaaaaattggaaacttctttagctgttgtgctgggaacgctcatatcaatacttttcttctctagaagttgaaaggggggaatattatcatgtcgaagtttgttataagagtcattctaccatacacaccatgattctgaaagtgctggtaaactacgggaataagatacatatttctcattattagaattcagacctcaaatgagtcgttggtcaactcagatccgaatcgaaagaacccaacgaatatataacttttattacatgtgttgtcttagtcagagtattccttaacattaactggttttcagacgatatgtaactgcagcagagtcaaatcatggatattgatagtagttagagaaccattgataatgttacaaccattttctaattttgatgttgtgtagacaattattagttgagcgagctaactaacagttcttacaaatctctactcatacaataaattccgtgagctcaacactaactcaacctaggtaacatcaaatgccgatatattcaggggttattatgcgagatatgcgcttagggataatagacactttacaaattgcgcatgcgatcgagatattttatgaatcgatataatatgcattcttatagaattgcctgttagcgtaacataaataaacgtatctaattacttttttatccacgcttattacatccgtaccatttccggccattcattaagatcggaagtaccttgcaatacaaaattaaactttaaataccctatcacgcagatttagcaattattttaatcaactttagtggatcaatcatagacatttttaagtggtattttcaaggtggcatttaaatattaatgatgacatattaaggttttaaatgagagaattcaattaatttggttagacaaagggatccgaagatattttatcgcaaccattaaaagggcgtacctctgtctacaataagcctttatttttaaatgtttgaagaaatcgtgaagacgactgttgtcaatacaaatatgataagaacagtactacatctttgctccgcaataatagtacagcttcaagtaatattcacagtaaaatggtatgtctggtactaagactttcatgactgttcgacgtttatactttaagtataaagagtagtgatccgatgtctggagattattctacatccaattgactctaagcacagccttcttggcttgctagtacattgaaagtgatatactcaactggacgagactcgaaaggaaatatgattgaccataagaccgctttgtttcgacatcgtcttagtacagtactcataattatcatcattcttttagtgcctattacaatgttggcaaaagaataaatctccatcacacttcttgaaaatgtacttggtcgtttgattgttgagaaagtttaatgatgagtatgttatttaaggcactggtgtactgatagagttggactaaatgttaattacgagtatataactcttcaataattcgctctatacgcaaattcctattatctgtgaaatgtttaacgcctatggtaactctgtaaaatatttatctacgttataccttagaatatcttaacggactatcgcaatatatctacttgtactgattaatgggaaagtaggtgcgataatcgaaggtatggtaaacgccggtaagtaattctaggcaacaaggaatgttatttttttaattattttttaaggcattgtacgtctaaatcatcaataaaatttgttgaaatcaccttgtttgattttgtaaaaatttgtcttaaaactatcaccgttaattaaagattactacactataattccagaatttacattcttaagctatttaaactaatctgtttccctaggcttctataaaatcgcgtcagtgattatcccccttggagacggatgtttttcgcaaataacaattaacaaatttctatgtcacttctgctgtcagcaattttgtttttactatacttgttatgatgtagattcgtcgcgttattgcgttgtcgaacttcataaaaagtgtctttttaccatgaccacgcgatataaaccccctatatacttggtgtcactctactagttttatacttacttcgtgctaattcaagaaatcggttttgtctcaatttatttgcattcagccgtcaatacagtatactctaatgaagatgactaaaccttcaatgcttaggcgtgctctaatatagttaaccgctatgtcagtctcattttgtatctctaaaattgggcggtaacatacatctccgtcttcaataacgacttcttatattgtattaaagtcttttatcgtgtatatgtaagccagtgcgatttctcaagtttcatcgtctcactgctcttctcaaattgttcgctaatttggcacatagtagtaagaaaatcagggataatgttacaaccgtttacttatttagaggtagtgtgaagaacttttacatgaaccagcaaactaacatctcttttaaattattactcttacaataagttccgtgacgacatgattatctcaacctgatttacaattaatgctcttatattgaaaagttattaagcgagatatgcatttaagcataatagacacatcacaagttgcggataccattaagacattttataaatagttgcattatggaatcttatagtataacctgatagcgttatattggtgaagatgactaattaccctttcacccgcgctattagcttccataccatttggcgccattcattaagatccgttgttccttacgaaaaaaaaattaataagaaattccgtaacatgcagatttagtagttattattaacaactttactggagcaaactaaaacatttatagacagaattttggtagaggcaattaatatctaatgatgtgatattagggtctaaattgtaagaattcgataaattaaattagataaggggattggaagatattttagcgcagttagttataggcggaacttttgcctacaaaaagcgtttattgttatttgtctaaagttacagcgaaaacagcagtcgttaaaacaaaaatgatatgtgcaatactacatctaagcagcgcaataacgcaacagcttaaggtatttttcatagaaaaattataggtccagttcaaacactttcatttgtgttcctcgtttatgcttttagtatgaaaactagtgcgccggtgtctggagatcatccttcttgcgtatgattgcatggactgccatcatgttttgtaagttcattgagactgttacgcttaactgcacgaaattcgagaaaatatacgactgttcgtaagagcgctttgattgaacacgatcataacagagcactcatgataatcatcatttttttagtccctattaca

What is claimed is:

1. A method for the controlled identification and/or quantification of transcript variants in one or more samples, the method comprising:
   a) providing a reference set of artificial nucleic acid (NA) molecules simulating transcript variants, comprising:
      at least two different families of NA molecules, with each family comprising at least two different NA molecules,
      wherein, independently for each family, all NA molecules are reference transcript variants of a same artificial gene, and
      wherein, independently for each family, the NA molecules share a sequence of at least 80 nucleotides (nt) in length and at least two NA molecules of said each family differ by at least another sequence of at least 80 nt length, and
      wherein at least two, optionally each, of said NA molecules are present in preset molar amounts; and
   b) adding a reference set as external control to the one or more samples comprising transcript variants; and
   c) either:
      c1) performing NA sequencing based on read generation and assignment wherein a reference read assignment is generated with the reads of the reference set and said reference read assignment is used to compare or adjust the read assignment of the transcript variants of the one or more samples, or
      c2) performing a NA detection or quantification method, optionally micro-array analysis or qPCR, on the one or more samples,
   wherein at least one probe binds to at least one NA molecule of the reference set and a measuring result based on a signal resulting from the at least one probe binding to the at least one NA molecule of the reference set is used to compare or adjust a measuring result based on a signal resulting from the transcript variants of the one or more samples binding to a probe in said NA detection or quantification method.

2. A method for evaluating a NA sequencing method, or for evaluating a NA detection or quantification method, the method comprising:
   a) providing a reference set of artificial NA molecules simulating transcript variants, comprising:
      at least two different families of NA molecules, with each family comprising at least two different NA molecules,
      wherein, independently for each family, all NA molecules of said each family are reference transcript variants of a same artificial gene, and
      wherein, independently for each family, the NA molecules of said each family share a sequence of at least 80 nt in length and at least two NA molecules of said each family differ by at least another sequence of at least 80 nt length, and
      wherein at least two of said NA molecules is present in preset molar amounts; and
   b) either:
      b1) for evaluating the NA sequencing method, performing NA sequencing based on read generation and assignment wherein a reference read assignment is generated with the reads of the reference set, or
      b2) for evaluating the NA detection or quantification method, performing said NA detection or quantification method on the reference set,
   wherein at least one probe binds to at least one NA molecule of the reference set; and
   c) comparing an output result of step b), in an output molar amount, an output concentration, and/or, in case of evaluating the NA sequencing method, a number of assigned reads, of at least one of the NA molecules of the reference set, and/or at least one ratio thereof of at least two NA molecules of the reference set, to said preset molar amounts and/or, in case of evaluating the NA sequencing method to a number of assigned reads, and/or a ratio and/or an output calculated or expected therefrom.

3. The method of claim 1, wherein the NA is RNA or DNA.

4. The method of claim 1, wherein the at least two families comprise at least three families.

5. The method of claim 4, wherein the at least three families comprise at least five families.

6. The method of claim 2, wherein the at least two families comprise at least three families.

7. The method of claim 6, wherein the at least three families comprise at least five families.

8. The method of claim 2, wherein each, of said NA molecules is present in preset molar amounts.

* * * * *